United States Patent
Hsu et al.

(10) Patent No.: US 10,476,825 B2
(45) Date of Patent: Nov. 12, 2019

(54) RNA TARGETING METHODS AND COMPOSITIONS

(71) Applicant: Salk Institute for Biological Studies, La Jolla, CA (US)

(72) Inventors: Patrick D. Hsu, San Diego, CA (US); Silvana Konermann, San Diego, CA (US)

(73) Assignee: Salk Institue for Biological Studies, La Jolla, CA (US)

( * ) Notice: Subject to any disclaimer, the term of this patent is extended or adjusted under 35 U.S.C. 154(b) by 0 days.

(21) Appl. No.: 15/937,699

(22) Filed: Mar. 27, 2018

(65) Prior Publication Data

US 2019/0062724 A1 Feb. 28, 2019

Related U.S. Application Data

(60) Provisional application No. 62/548,846, filed on Aug. 22, 2017, provisional application No. 62/572,963, filed on Oct. 16, 2017, provisional application No. 62/639,178, filed on Mar. 6, 2018.

(51) Int. Cl.

| | |
|---|---|
| C12N 15/85 | (2006.01) |
| H04L 12/58 | (2006.01) |
| C12N 15/10 | (2006.01) |
| C12N 15/113 | (2010.01) |
| C12N 15/82 | (2006.01) |
| C12N 9/22 | (2006.01) |
| H04L 9/08 | (2006.01) |
| H04L 9/30 | (2006.01) |
| H04L 12/741 | (2013.01) |

(52) U.S. Cl.
CPC ............ *H04L 51/12* (2013.01); *C12N 9/22* (2013.01); *C12N 15/102* (2013.01); *C12N 15/113* (2013.01); *C12N 15/8201* (2013.01); *C12N 15/8213* (2013.01); *C12N 15/85* (2013.01); *H04L 9/08* (2013.01); *H04L 9/30* (2013.01); *H04L 45/745* (2013.01); *H04L 51/08* (2013.01); *H04L 51/14* (2013.01); *H04L 51/18* (2013.01); *C12N 2310/16* (2013.01); *C12N 2310/20* (2017.05); *C12N 2310/3519* (2013.01)

(58) Field of Classification Search
None
See application file for complete search history.

(56) References Cited

U.S. PATENT DOCUMENTS

| | | |
|---|---|---|
| 8,871,445 B2 | 10/2014 | Cong et al. |
| 2016/0208243 A1 | 7/2016 | Zhang et al. |
| 2017/0145394 A1 | 5/2017 | Yeo et al. |
| 2018/0282715 A1 | 10/2018 | Carter et al. |
| 2018/0334685 A1 | 11/2018 | Yeo et al. |
| 2019/0002875 A1 | 1/2019 | Cheng et al. |
| 2019/0002889 A1 | 1/2019 | Cheng et al. |

FOREIGN PATENT DOCUMENTS

| | | |
|---|---|---|
| WO | WO 2016/205764 A1 | 12/2016 |
| WO | WO 2018/172556 A1 | 9/2018 |
| WO | WO 2018/183403 A1 | 10/2018 |

OTHER PUBLICATIONS

Bork (Genome Research, 10:348-400, 2000).*
Smith et al (Nature Biotechnology 15:1222-1223, 1997).*
Brenner (TIG 15:132-133, 1999).*
Broun et al. (Science 282:1315-1317, 1998).*
Van de Loo et al. (Proc. Natl. Acad. Sci. 92:6743-6747, 1995).*
GenBank Accession No. HF545617.1 "Ruminococcus bicirculans chromosome II, complete genome," Feb. 27, 2015.
Wegmann et al., "Complete genome of a new Firmicutes species belonging to the dominant human colonic microbiota ('*Ruminococcus bicirculans*') reveals two chromosomes and a selective capacity to utilize plant glucans", *Environ Microbiol.* 16:2879-2890, 2014.
Zhang et al., "Structural basis for the RNA-guided ribonuclease activity of CRISPR-Cas13d," BioRxiv, doi: http://dx.doi.org/10.1101/314401, published May 4, 2018 [retrieved from Internet on Oct. 30, 2018].
PCT/US2018/047597 International Search Report and Written Opinion dated Oct. 18, 2018 (14 pages).
Abudayyeh et al., "C2c2 is a single-component programmable RNA-guided RNA-targeting CRISPR effector," *Science* 353:aaf5573, 2016.
Abudayyeh et al., "Supplementary Material for C2c2 is a single-component programmable RNA-guided RNA-targeting CRISPR effector," *Science* 353:aaf5573, 2016.
Anantharaman et al., "Comprehensive analysis of the HEPN superfamily: identification of novel roles in intra-genomic conflicts, defense, pathogenesis and RNA processing," *Biol. Direct* 8:15, 2013.
Barrangou and Gersbach, "Expanding the CRISPR Toolbox: Targeting RNA with Cas13b," *Mol. Cell* 65:582-584, 2017.
East-Seletsky et al., "Two distinct RNase activities of CRISPR-C2c2 enable guide-RNA processing and RNA detection," *Nature* 538:270-273, 2016.
East-Seletsky et al., "RNA Targeting by Functionally Orthogonal Type VI-A CRISPR-Cas Enzymes," *Mol. Cell* 66:373-383, 2017.
Fonfara et al., "The CRISPR-associated DNA-cleaving enzyme Cpf1 also processes precursor CRISPR RNA," *Nature* 532:517-521, 2016.
Gootenberg et al., "Nucleic acid detection with CRISPR-Cas13a/C2c2," *Science* 356:438-442, 2017.
Grissa et al., "CRISPRFinder: a web tool to identify clustered regularly interspaced short palindromic repeats," *Nucleic Acids Res.* 35:W52-7, 2007.
Konermann et al., "Transcriptome Engineering with RNA-Targeting Type VI-D CRISPR Effectors," *Cell* 173:1-12, 2018.
Makarova et al., "An updated evolutionary classification of CRISPR-Cas systems." *Nature Reviews Microbiology* 13:722-36, 2015.
Nelles et al., "Programmable RNA Tracking in Live Cells with CRISPR/Cas9," *Cell* 165:1-9, 2016.

(Continued)

*Primary Examiner* — Celine X Qian
(74) *Attorney, Agent, or Firm* — Klarquist Sparkman, LLP

(57) ABSTRACT

Provided herein are CRISPR/Cas methods and compositions for targeting RNA molecules, which can be used to detect, edit, or modify a target RNA.

29 Claims, 87 Drawing Sheets

Specification includes a Sequence Listing.

(56) References Cited

OTHER PUBLICATIONS

O'Connell et al., "Programmable RNA recognition and cleavage by CRISPR/Cas9," *Nature* 516:263-266, 2014.
Sapranauskas et al., "The *Streptococcus thermophilus* CRISPR/Cas system provides immunity in *Escherichia coli*," *Nucleic Acids Res.* 39:9275-9282, 2011.
Shmakov et al., "Discovery and Functional Characterization of Diverse Class 2 CRISPR-Cas Systems," *Mol. Cell* 60:385-397, 2015.
Shmakov et al., "Diversity and evolution of class 2 CRISPR—Cas systems," *Mol. Cell* 15:169-182, 2017.
Smargon et al., "Cas13b Is a Type VI-B CRISPR-Associated RNA-Guided RNase Differentially Regulated by Accessory Proteins Csx27 and Csx28," *Mol. Cell* 65:618-630, 2017.
Stendahl, "Biotech Startup Co-Founded by MIT's Feng Zhang Unveils New CRISPR Tool," *Boston Business Journal*, https://www.bizjournals.com/boston/news/2018/03/15/biotech-startup-co-founded-by-mit-s-feng-zhang.html, accessed Mar. 15, 2018.
Yan et al., "Cas13d Is a Compact RNA-Targeting Type VI CRISPR Effector Positively Modulated by a WYL-Domain-Containing Accessory Protein," *Mol. Cell* 70:1-13, 2018.

\* cited by examiner

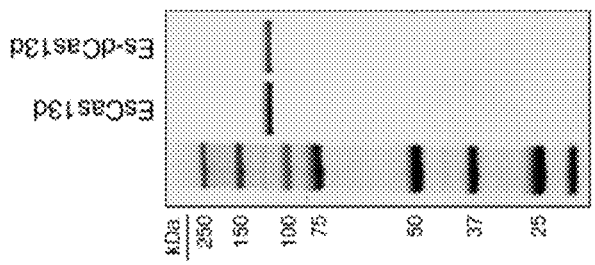
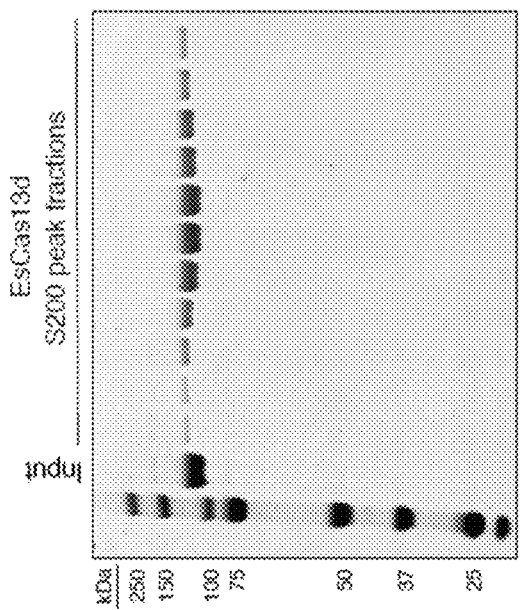
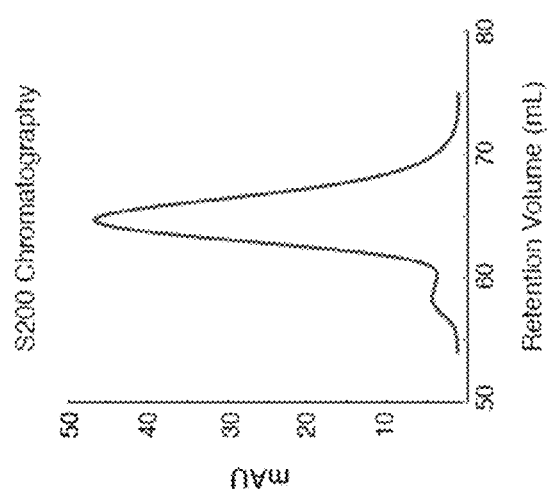

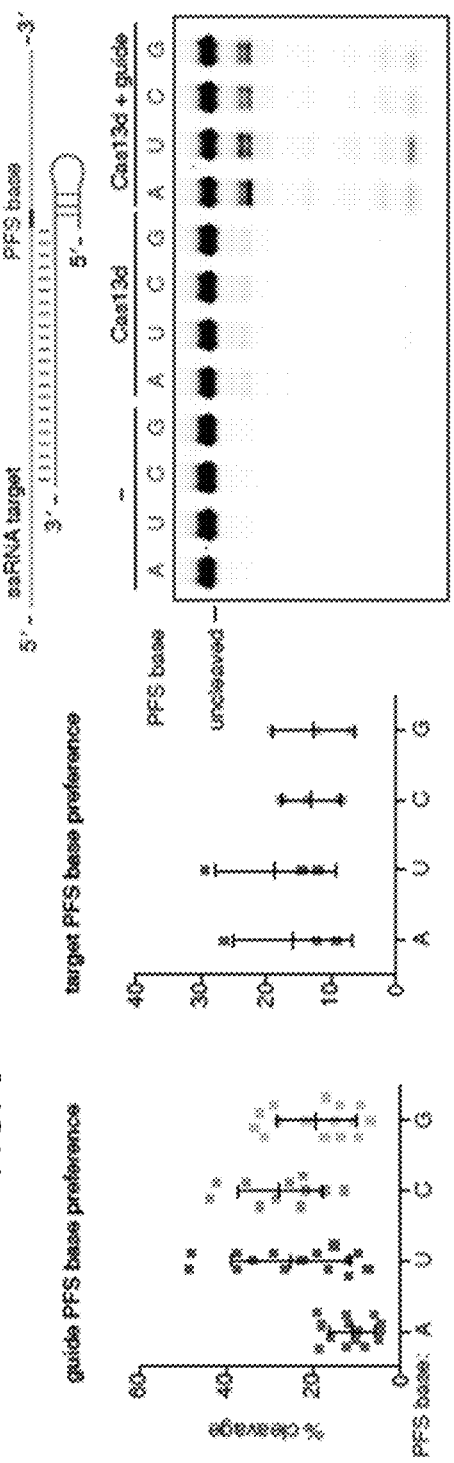
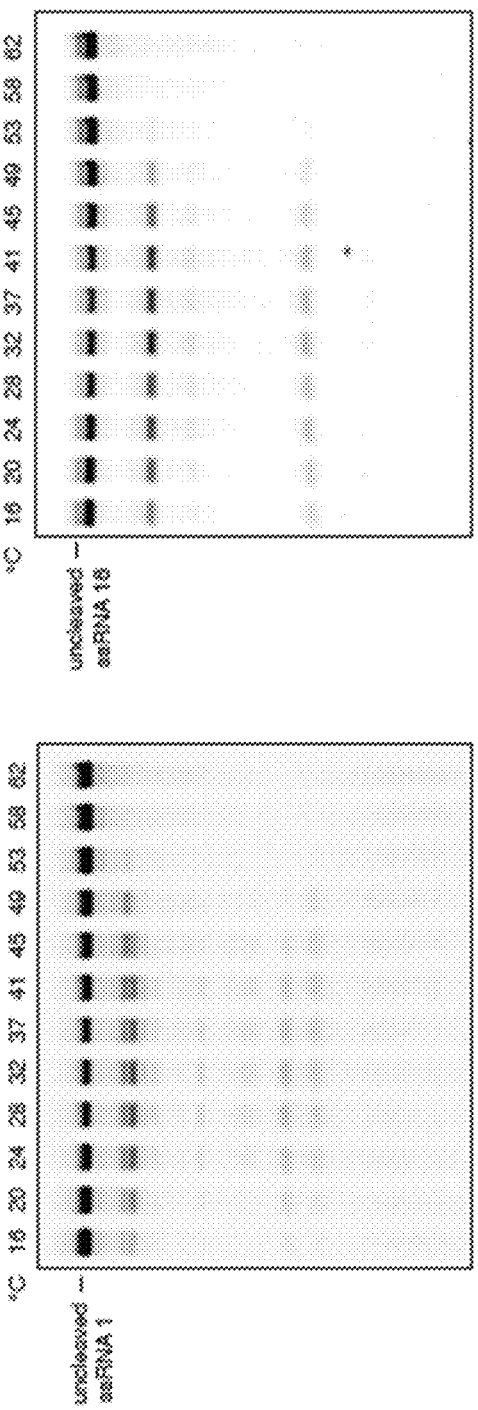
FIG. 6E
FIG. 6F
FIG. 6G
FIG. 6H

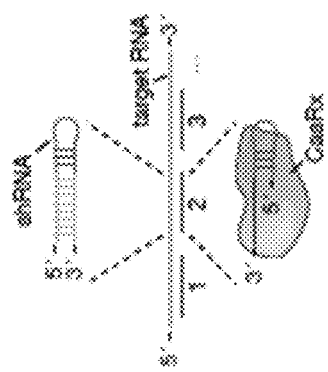
FIG. 9A
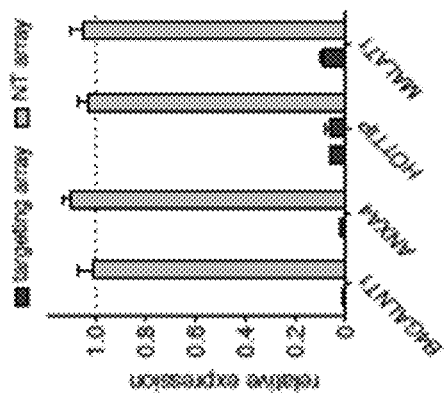
FIG. 9B  FIG. 9C
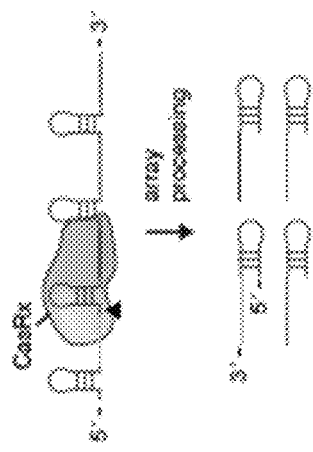
FIG. 9D
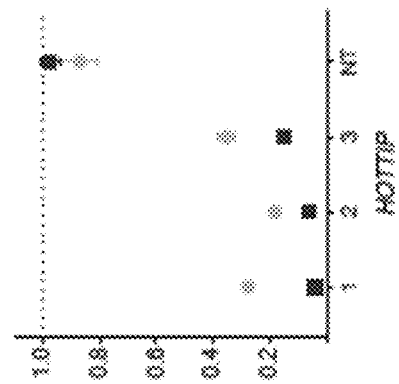
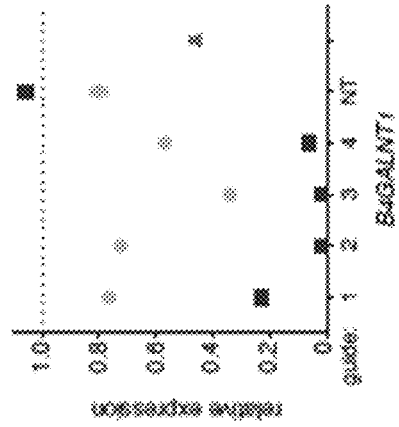

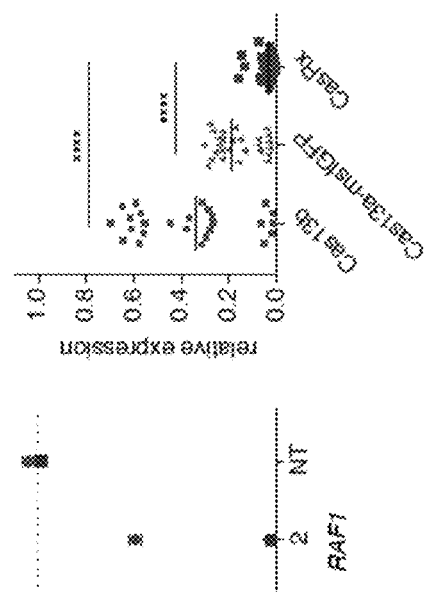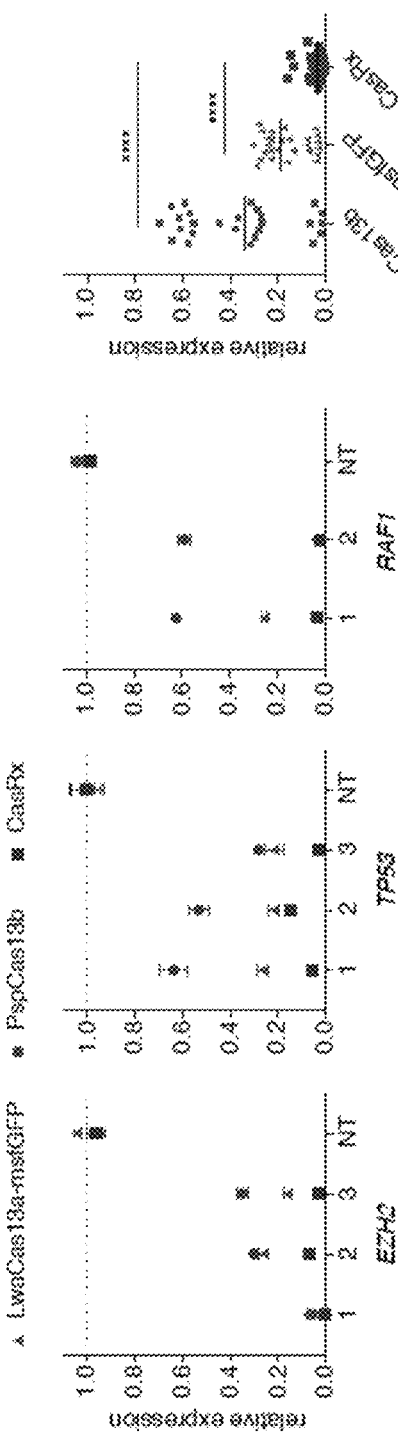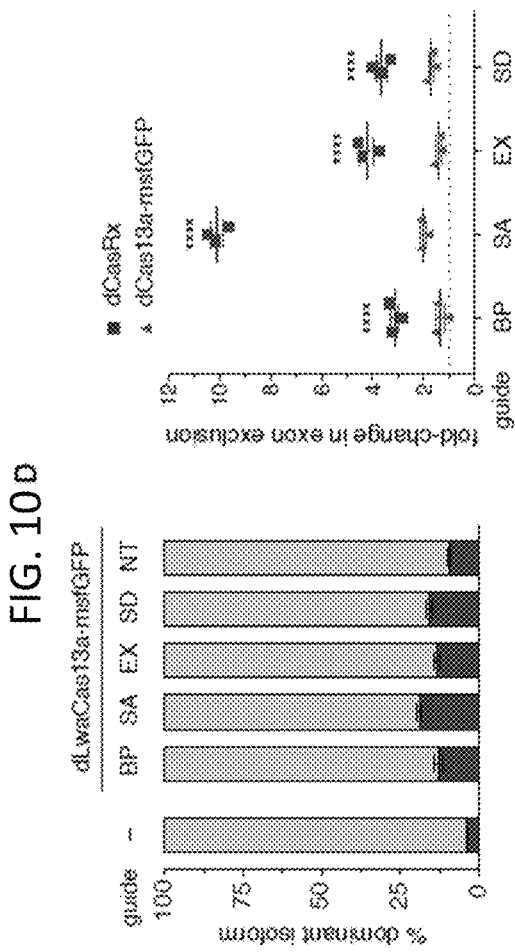
FIG. 10A
FIG. 10B
FIG. 10C
FIG. 10D

CLUSTAL O(1.2.4) multiple sequence alignment

```
037_--_emb|OIZA01000315.1|                    ------------------------------------------MAKKKRMTAKERKQNHRESL-------MK    22
emb|OCTW01158726.1|                           ----------------------------------------------------------------------     0
k87_11092736                                  ----------------------------------------------------------------------     0
BMZ-11B_GL0037915                             ----------------------------------------------------------------------     0
BMZ-11B_GL0037771                             ----------------------------------------------------------------------     0
BMZ-11B_GL0069617                             ----------------------------------------------------------------------     0
Ga0099364_10024192                            ----------------------------------------------------------------------     0
530373_GL0023589                              ----------------------------------------------------------------------     0
emb|ODAI01161274.1|                           ---------------------------------------------MKKKISLKEQRNTKKAEN------KL    20
EMG_10003641                                  ----------------------------------------------------------------------     0
CasR_P1E0_metageno                            ----------------------------------------------------------------------     0
emb|OIZX01000427.1|                           ---------------------------------------------MAKKKKTARQLREEMQQQR-----KQ    21
160582958_gene49834                           ----------------------------------------------MKNSVTFKLIQAQENKEA-----AR    20
gi|1119854231|gb|NFIR01000008.1|              -----------------------------------------------MAKKLRPKELREKRRMAE----KE    20
emb|OGNF01009141.1                            ----------------------------------------------------------------------     0
Ga0129306_1000735                             ----------------------------------------------------------------------     0
MH0288_GL0082219                              -----------------------------------------------MKKMTAKERREQEKQKR----AE    19
PIG-022_GL0026351                             ----------------------------------------------------------------------     0
PIG-028_GL0185479                             ----------------------------------------------------------------------     0
250twins_35838_GL0110300                      -------------------------------------------MGNKQRVSAQKRRENAKLCN------QQ    22
PIG-014_GL0226364                             ----------------------------------------------------------------------     0
250twins_36050_GL0158985                      ----------------------------------------------MKKKHQSAAEKRQVKKLKN-----QE    21
```

FIG. 18A

| | | |
|---|---|---|
| emb\|OJMM01002900.1\| | -----------MGKKHLNAKQRKLEKKLKN---------QQ | 20 |
| emb\|OGPN01002610.1\| | -----------MAKKITAKQREEKERLN---------KQ | 20 |
| emb\|OHCP01000044.1\| | -----------MAKKITAKQREEKERLN---------KQ | 20 |
| PIG-046_GL00077813 | -----------MAKKITAKQRREERERQN---------KQ | 20 |
| pig_chimera | -----------MAKKITAKQRREERERQN---------KQ | 20 |
| emb\|OIEN01002196.1\| | --------------------------------- | 0 |
| O2.UC29-0_GL00096317 | --------------------------------- | 0 |
| CasR_Anaerobic_dig | --------------------------------- | 0 |
| emb\|OGDF01008514.1\| | --------------------------------- | 0 |
| emb\|OGZC01000639.1 | ------------MKKKNIRATREALKAQK---------IK | 19 |
| Ga0224415_10048792_chimera | --------------------------------- | 0 |
| emb\|OCVV01288914.1\| | --------------------------------- | 0 |
| Ga0187910_10006931 | --------------------------------- | 0 |
| R._flav_XPD_ | --------------------------------- | 0 |
| Ga0224415_10007274 | --------------------------------- | 0 |
| Ga0187911_10069260 | --------------------------------- | 0 |
| Ga0187910_10015336 | MLKKCSVCGKKFETNYQGGKPVCRNCRSNKSKPVNPKSSRPESIDK---------Ai | 31 |
| ODAi_chimera | ---------------------MENVKNPKEIVKGAKVRFEIYENPKPKKQNQ | 49 |
| 31009_GL0034153 | --------------------------------- | 0 |
| DLF014_GL0011914_ | -----------MAKKKNAKQRREEKNRL---------KA | 20 |
| CasR_R._albus | -----------MAKKSKGMSLREKRELEKQKR---------IQ | 23 |
| Ga0187910_10040531 | -----------MAKKKKAKQRREEQEAAR---------MN | 20 |
| tpg\|DJXD01000002.1\| | --------------------------------- | 0 |
| CasR_E._siraeum | -----------MGKKIHARDLREQRKTDR---------TE | 20 |

FIG. 18B

```
PIG-018_GL0023397                    ----------------------------------------MAKKLSPRELREQRERER----------QA  20
PIG-025_GL0099734                    ------------------------------------------MAKKMNAKEQRAAIQAEK-------NK  20
Ga0129317_1008067_chimera            ---------------------------------------------------------------------   0
EYZ-362B_GL0088915                   -----------------------------------------MKKKLNIREQREAKKAAA-------KQ  20
uncultured_Ru_sp                     -------------------------------------------MAKKNKMKPRELREAQKKAR-----QL  22
R._flav._FD-1                        ------------------------------------------MKKKMSLREKREAEKQAK-------KA  20
tpg:DBYI01000091.1:                  ------------------------------------------MKKKIKARDLREAKKQEK-------LA  20

037_--_emb:OIZA01000315.1:           KADSNAEKEKAKKPVVENK--------------------PDTAISKDNKPKPNKEIKKSKAK        64
emb:OCTW01158726.1:                  ------------------------------------------MKQNDRENNKIKKSAAK          18
k87_11092736                         ----------------------------------------------MKRQKTFAK               9
BMZ-11B_GL0037915                    ---------------------------------------------MAEHSKKTAAK              11
BMZ-11B_GL0037771                    ---------------------------------------------MSKDKKTKAK               10
BMZ-11B_GL0069617                    ---------------------------------------------MPHNKKSTIK               10
Ga0099364_10024192                   ---------------------------------------------MSQSTKTKAK               10
530373_GL0023589                     --------------------------------MKTEMKNGEVKTSAKKENCSIAK                23
emb:ODAT01611274.1:                  KYQKAQAERAAAAQTAAGAESEENPCFDVVKDT---KRKALNPLHVEIEAPSAKKSSVK            77
EMG_10003641                         -----------------------------MEET-------KVT----KETTIEKQSTKRHKQKSKKTATK  30
CasR_P1E0_metageno                   ----------------------------------------MEREVKKPPKKSLAK                15
emb:OIZX01000427.1:                  AIQKQQEQRQ--------EKAA------AAR---ETAAPEQPAAAPVPKKQRKSLAK              61
160582958_gene49834                  KKAKDIAEQARIAKRNGVVKKEENRI----------QIEIQTCKKSNTQNAYHLKSLAK            72
gi:119854231:gb:NFIR01000008.1:      EHKKQEK-------LRKEQEELRKKQEKQ--------RED----QKELEKIKKEEGGEGEKKKSGAK    68
emb:OGNF01009141.1:                  ---------------------------------------------MADIDKKKSSAK             12
```

FIG. 18C

| | | |
|---|---|---|
| Ga0129306_1000735 | ------------------------------MQK----QREQQTVTDESERKKKPLKSGAK | 26 |
| MH0288_GL0082219 | V----------------------IRGKQEAN------RKK----AQAAATQDATAPVHHKNAKSLAK | 54 |
| PIG-022_GL0026351 | ----------------------------------------------MAESYKIKSKKTRTK | 15 |
| PIG-028_GL0185479 | ------------------------------------------------MSESDKIKISKKTRTK | 17 |
| 250twins_35838_GL0110300 | KARQAESQRDKIKNMNVEK-------------------M------------KNINTNDIKHTKTTAK | 58 |
| PIG-014_GL0226364 | --------------------------------------------MTKPEKKQIKQATLTK | 16 |
| 250twins_36050_GL0158985 | KAQKYASEPSPLQSDTAGV----------------------EC------SQKKTVVSHIASSKTLAK | 60 |
| emb|OJMM01002900.1| | KDMMYTKSTIDAVSVPTLKA-------------------APTKAEMSQDTAEASTLITPGTLKTKAK | 67 |
| emb|OGPN01002610.1| | KWAKQDTPVVPKSKTEEKP--------------------V----AASDDKLLKTIQVKKVQTKSKAK | 63 |
| emb|OHCF01000044.1| | KWAKNDSVIIVPETKEEIK----------------------------TGEIQDNNRKRSRQKSQAK | 58 |
| PIG-046_GL0077813 | KWAKKQDDATAVFECEANI----------------------KP----ADSKDEDCANT---SIKRKKTQAK | 62 |
| pig_chimera | KWAKKQADATAVFECEADI----------------------KP----ADSKDEDCTNIYIKREKKTQAK | 64 |
| emb|OIEN01002196.1| | ---------------------------------------------MERQKRMKSKSK | 13 |
| O2.UC29-0_GL0096317 | ---------------------------------------------MERQKRRKKSCAK | 13 |
| CasR_Anaerobic_dig | ------------------------------------------------MNNKRKTKAK | 10 |
| emb|OGDF01008514.1| | ---------------------MTETKPKREDIAKTPAAKSRSK | 22 |
| emb|OGZC01000639.1| | KSQENEALKKQKLAEEAAQ----------KRREELEKKNLAQWEETSAEGRRSRVK | 65 |
| Ga0224415_10048792_chimera | ---------------------------------------MSKKENRKSYVK | 12 |
| emb|OCVV012889144.1| | ------------------------------------------MSKNKESYAK | 10 |
| Ga0187910_10006931 | ------------------------------------------MIEKKKSYAK | 10 |
| R._flav_XPD_ | ------------------------------------------MIEKKKSFAK | 10 |
| Ga0224415_10007274 | ------------------------------------------MIEKKKSYAK | 10 |
| Ga0187911_10069260 | ----------------------------------------MSTKKRFRYSVAAK | 14 |
| Ga0187910_10015336 | RFSAINVEVITDETHKEAKIQKNEFKITFDQFTKE-LQETQKVNGETKKEHITKNKHTNVK | 90 |

FIG. 18D

```
ODAI_chimera                        EILTEKLISDCKK-------------------------------NDCASECGKGRRKSKAK    79
31009_GL0034153                     ---------------------------------------------MGSRGVIMTEKRKSRAK    18
DLF014_GL0011914_                   KIEKFKIKYAEQETVDKI----------TEEIAQSDKIMRTESILVQHTKKSLAK           65
CasR_R._albus                       KAAVNSVNDTPERTEEAN----------VVSVNVRTSAENKHSKKSAAK                 62
Ga0187910_10040531                  KIQSAVKAKAETAPA-------------VSSAFVEKRKDKQSKKTFAK                  55
tpg|DJXD01000002.1|                 ---------------------------------------------MKKQKSKKTVSK        12
CasR_E._siraeum                     KFADQNKKREAERAVPKK----------DAAVSVKSVSVSSKKDNVTKSMAK              63
PIG-018_GL0023397                   KFAKQVQEREAEKAKREK----------QVSVSDTVGAAAAVQNENGKKSMAK             63
PIG-025_GL0099734                   KIQMANAAREKQAEEARLKAEAERIEKEENKKREAELKRFKLDQETRGKLPKNERKSLAK      80
Ga0129317_1008067_chimera           ---------------------------------------------MKKQKKSLVK          10
EYZ-362B_GL0088915                  IYAAKASAAQKKADETV-----------VAAQPAGDTANSKPIKSRNK                  57
uncultured_Ru_sp                    KAAEINNNAAPAI------A--------AMPAAEVIAPAAEKKKSSVK                  56
R._flav._FD-1                       AYSAASKNTDSKPAEKKA----------ETPKPAEIISDNSRNKTAVK                  58
tpg|DBYI01000091.1|                 AFSAKANTVYENEDK-------------NVEAFPEALNLRSIKKSMNK                  55
                                                                                        *

037_--_emb|OIZA01000315.1|          LAGVKWIIKAN--DD-------VTYISSFGKGN--------NSVLEKRIIGDVSGDVN-----  105
emb|OCTW01158726.1|                 AVGVKSLARLS---DG------STVVSSFGKGA--------AAELESLITGGEIRKLS-----   59
k87_11092736                        RIGIKSTVAYG---QG------KYAITTFGKGS--------KAEIAVRSADPPEETLPTESD    54
BMZ-11B_GL0037915                   RVGIKSVIAHD--GG-------KLAVTTFGKKS--------AAKLAYRDGDQTPFDEEKKSE    56
BMZ-11B_GL0037771                   RMGVKALLAHG---ED------KLTMTTFGKGN--------RSKIEFTEGYHGRALETPKHF    55
BMZ-11B_GL0069617                   RIGVKSAFSHG--NS-------RLTITQFGRGN--------TADIAVETDSRGRSLSLPHRV    55
Ga0099364_10024192                  RMGVKSVLAHG--KDEKGHIKLAITAFGKGN----------KAELAIQTDEKGSNLAKTYKE    60
530373_GL0023589                    ANGLKSTFKLA---EN------TYYMTSFGKNN--------TADPEKNIVRMNVENIR-----   64
```

FIG. 18E

| | | |
|---|---|---|
| emb\|ODAI011611274.1\| | ANGLKSLLLT---DG--------KTVMTSFGRGS--------EANVEKRPDETGTKTFD------ | 117 |
| EMG_10003641 | MSGLKSALVIN---NH--------EMLLTSFGKGN---------NAIAEKRYILDGDIETI---N | 72 |
| CasR_P1E0_metageno | AAGLKSTFVISPQEK--------ELAMTAFGRGN---------DALLQKRIVDGVVRDVA---- | 58 |
| emb\|OIZX01000427.1\| | AAGLKSNFILDPQRR--------TTVMTAFGQGS---------TAILEKQIVDRAISDLQ---- | 104 |
| 160582958_gene49834 | AAGVKSVFPAI----GN-------DLLMTGFGPGN---------DATIEKRVFQNRAIETL--- | 112 |
| gi\|1119854231\|gb\|NFIR01000008.1\| | ALGLKSTFILERDEQ--------KMLMTSFGRGN---------KAVRDKYIIGDKVSDIDDSWE | 115 |
| emb\|OGNF01009141.1 | AAGLKSTFVLE---NN--------KLLMTSFGNGN---------KAVIEKIIDEKVDSIN---- | 52 |
| Ga0129306_1000735 | AAGLKSVFVLS---EG--------KELLTSFGRGN---------EAVPEKRVTGGTIANAR---T | 68 |
| MH0288_GL0082219 | AAGLKSTFTLP---TG--------ELLMTSFGRGS---------EALIQKRIMKDVISDVQ---- | 95 |
| PIG-022_GL0026351 | RAGLKSSFVN----EN--------KGLMTAFGKGN---------NAVIEKRISGNLIENVS---- | 55 |
| PIG-028_GL0185479 | RAGLKSSFVS----EG--------KGLMTAFGKGN---------NAVIEKRISGDLIENVS---- | 57 |
| 250twins_35838_GL0110300 | KLGLKSTIIAD---K---------KIILTSFINEQ---------SSKTANIEKVAGFKGDTIDT-IS | 103 |
| PIG-014_GL0226364 | RMGLKSTLVFD---N---------KITVTSFANSS---------NSEKASAHIEKRTDFWGKTI---M | 60 |
| 250twins_36050_GL0158985 | AMGLKSTLVMG---D---------KLVTTSFAASKAVGGAGVKSANIEKITDLQGRVI-------E | 107 |
| emb\|OJMM01002900.1\| | AMGLKSTLVFD---D---------KIVVTSFLNSKT--EENEKCAHIEKIADCNGQTI------V | 112 |
| emb\|OGPN01002610.1\| | AMGLKTVLSFD---D---------KIAIASFVNDK---------KTKLPHIERITDKSGTTI------H | 105 |
| emb\|CHCP01000044.1\| | AMGLKAVLSFD---N---------KIAIASFVSSK---------NAKSSHIERITDKEGTTI---S | 100 |
| PIG-046_GL0077813 | AMGLKTVLGFD---N---------KIAIASFTSSK---------DSKSSHIERITDPNGKTI------R | 104 |
| pig_chimera | AMGLKTVLGFD---N---------KIAIASFMSSK---------DSKSSHIERITDPNGKTI------R | 106 |
| emb\|OIEN01002196.1\| | MAGVKSVFVIG---D---------ELLMTSFGDGD---------DAVLEKDIDENGVVNDC---R | 54 |
| O2.UC29-0_GL0096317 | MAGVKSTFVID---S---------DLLMTSFGERD---------KAVREKYIAQGNVKSLR---K | 54 |
| CasR_Anaerobic_dig | AAGLKSVFFDQ---K---------QAVLTTFAKGN---------NSQIEKKVVNSEVKDLR---Q | 51 |
| emb\|OGDF01008514.1\| | AAGLKSTFAVN---G---------SVLLTSFGRGN---------DAVPEKLITEKAVSEIN---T | 63 |
| emb\|OGZC01000639.1 | AVGVKSVFVVG---D---------DLYLATFGNGN---------ETVLEKKITPDGKITTF---P | 106 |

FIG. 18F

| | | | |
|---|---|---|---|
| Ga0224415_10048792_chimera | GLGLKSILVSD---S-------KVYLITFADGS--------NAKLEKCVENNKIICIS----N | 53 |
| emb\|OCVV012889144.1\| | GMGLKSALVSG---S-------KVYMTSFEGGN--------DAKLEKVVENSEIVSLA----- | 50 |
| Ga0187910_10006931 | GMGLKSTLVSD---S-------KVYMTSFGNGN--------DARLEKVVENNAISCLV----D | 51 |
| R._flav_XPD_ | GMGVKSTLVSG---S-------KVYMTTFAEGS--------DARLEKIVEGDSIRSVN----- | 50 |
| Ga0224415_10007274 | GMGLKSTIVSG---S-------KVYMTEFGDGS--------EARLEKVVENDSIKTLH----- | 50 |
| Ga0187911_10069260 | AAGLKSSLAVD---TD------RIVMTSFGHGN--------AAILEKEIVDGEISVLN----I | 56 |
| Ga0187910_10015336 | AAGVKSVFAVD--DG-------NVLITSFGRGN--------AADIETLKSDDDKTINL----T | 132 |
| ODA1_chimera | AAGLKSALDLG--NG-------QALITSFGKGN--------EAVEPKRVEGDKIISLR----E | 121 |
| 31009_GL0034153 | ALGVKSAFLKD---D-------DVIMTSFGRGN--------DAVVEKIIKNNEVQNIN----I | 59 |
| DLF014_GL0011914_ | ASGVKSVFIKD---D-------EVIMTSFGRGN--------DAVVEKIIKDNNVDEK----N | 105 |
| CasR_R._albus | ALGLKSGLVIG---D-------ELYLITSFGRGN--------EAKLEKKISGDTVEKLG----I | 103 |
| Ga0187910_10040531 | ASGLKSTLAVD---N-------SAVMTVFGRGN--------EAKLDHRINADLQSESL----H | 96 |
| tpg\|DJXD01000002.1\| | TSGLKEALSVQ---G-------TVIMTSFGKGN--------MANLSYKIPSSQKPQNL----N | 53 |
| CasR_E._siraeum | AAGVKSVFAVG---N-------TVYMTSFGRGN--------DAVLEQKIVDTSHEPLN----I | 104 |
| PIG-018_GL0023397 | AAGVKSVFAVG---D-------TVYMTSFGRGN--------DAVLEKKIVDESHESLN----K | 104 |
| PIG-025_GL0099734 | AAGLKSTFAVG---T-------DLYMTSFGKGN--------DAIVEKKISNKQVTQIN----T | 121 |
| Ga0129317_1008067_chimera | AAGLKSAFVVG---D-------SVVLTSFGKGN--------AARLDTKINPDNSTERY----V | 51 |
| EYZ-362B_GL0088915 | AAGLKSTFVVG---D-------SLYMTSFGKGN--------LSVFEYRVDIGDAYRVD----P | 98 |
| uncultured_Ru_sp | AAGMKSILVSE---N-------KMYITSFGKGN--------SAVLEYEVDNNDYNQTQ----L | 97 |
| R._flav_FD-1 | AAGLKSTIISG---D-------KLYMTSFGKGN--------AAVIEQKIDINDYSFSA----- | 98 |
| tpg\|DBYI01000091.1\| | AAGLKSTLIDG---K-------SLYLTAFGKGN--------NAVVEHMIATDDSYSLK----T | 96 |
| | *:* : * : * | |
| 037_--_emb\|OIZA01000315.1\| | ---KDSHMYVNPKYIKKNYEIKNGF-------------------SSGSSLVTY | 136 |

FIG. 18G

| | | |
|---|---|---|
| emb:OCTW01587266.1: | ----------D--KAILEITDDIQNKNAYNVKS------------------------SRIPNLTAR | 89 |
| k87_11092736 | ATLSIHAKFAKAGRDGREFKCGDVD-------------------ETRI----HTSRS | 88 |
| BMZ-11B_GL0037915 | ----------LGGFNVTGVDENTVDAERGI---------------PGEGLIEASVAN | 88 |
| BMZ-11B_GL0037771 | G-----KRGFEVRKIDENVDLYGDL-----------------------EEGK | 79 |
| BMZ-11B_GL0069617 | ----------EKSFTVNKIDDEIDVQRS------------------------------ | 73 |
| Ga0099364_10024192 | ----------RNITANKIVSEGIQTSGTI------------------------AGE | 82 |
| 530373_GL0023589 | ----------NTFSATPISERIVDITGET------------------------------ | 83 |
| emb:ODAI01611274.1: | ----RDPELFSAKPLETGYRIQRFNA---------------S-----PKDAG---- | 145 |
| EMG_10003641 | ----------NKNKKFDANNDSKVVVIKGISN---------------PNGQLTN | 101 |
| CasR_P1E0_metageno | ----GEKQQFQVQRQDESRFRLQNSR---------------LADRTVTADD | 90 |
| emb:OIZX01000427.1: | ----PVQQFQVEPASAAKYRLKNSR---------------VRFPNVTADD | 135 |
| 160582958_gene49834 | ----SSPEQYSAEFQNKQFKIKGNIK---------------VLNHS--TQKMEEIQTE | 149 |
| gi|1198542314|gb|NFIR01000008.1| | ----NKKAALSVEVCGKSFNISKKEN---------------DDCEPVKVNN | 147 |
| emb:OGNF01009141.1 | ----EPEVFSVTPCDKKFELQPAKR---------------GLAADSLVDN | 83 |
| Ga0129306_1000735 | ----DNKEAFSAALQNKRFEVFGR---------------TAGSSDD | 95 |
| MH0288_GL0082219 | ----EGDPAFSVIPMPKQFEIQGRAI-------------DVQKEGSSVPEVLTDD | 133 |
| PIG-022_GL0026351 | ----NKPRFSVEFGNKEYIINDK---------------KLGIVSDD | 82 |
| PIG-028_GL0185479 | ----NKPRFSVEFGNKEYIINDK---------------KLGIVSDD | 84 |
| 250twins_35838_GL0110300 | ----YTPRMFRSEINPGEIVISKGD---------------DLSEFAN | 131 |
| PIG-014_GL0226364 | ----QDEKMFRTDVEKQQIYIEKEFPDENNKII------------T-----QTAMFEN | 97 |
| 250twins_36050_GL0158985 | ----EHERMFSADVGEKNIELSKND---------------CHINVNN | 135 |
| emb:OJMM01002900.1: | ----ERPRMFNTSINAKKVDLSKDN---------------DETNYPN | 140 |
| emb:OGPN01002610.1: | ----ENARMFDSSVDEQVNIEKRMTIEEKQND-------GTFKKDEKDVKATICN | 150 |
| emb:OHCP01000044.1: | ----VNSKMFESSVNKRDINIEKRITTEEPQQD------GTIKKEEKGVKSTTCN | 145 |

FIG. 18H

```
PIG-046_GL0077813          ----EDVRMFDSNVDECSINLEKRMTVEERQKD----------------GTIKKDEKDVKSTICN  149
pig_chimera                ----EDVRMFDSNVDECSINLEKRMTVEERQKD----------------GTIKKDEKDVKSTICN  151
emb|OIEN01002196.1|        ------N-PAAYDAVYGTDSIRVKKTN------------------------NMIRAKVNN       83
O2.UC29-0_GL0096317        -----Q-EQAFDAQYGKEKIFVTNAD-------------------------NKLHVAINN       83
CasR_Anaerobic_dig         ----P---PAFDLELKEKIFYISGKNNINTSRENPLASASLPLSKRQRIRAERIKRAREENR    106
emb|OGDF01008514.1|        ------V-KPRFSVEKPATSYSSSF------------------------GIKSHISATADN     93
emb|OGZC01000639.1|        -----E--EETFTAKLKFAQTEPTVATSI--------------------GISNGRIVLPEISVDN 144
Ga0224415_10048792_chimera -------D-KEAPAASIAMKNVGYKIKND--------------------EKFRHPKGYDIISNM   89
emb|OCVV012889144.1|       -------E-KESFSAEIFKKNIGCKIE-N--------------------KKFKHPKRYDVLADN   85
Ga0187910_10006931         --------K-KEAFVAEITDKNAGYKII--N--------------------KKFGHPKGYDVVANN 86
R._flav_XPD_               -------E--GEAFSAEMADKNAGYKIG--N--------------------AKFSHPKGYAVVANN 85
Ga0224415_10007274         -------E--GEAFSAEMTDNNAGYKIG--N--------------------VKFSHPNGYDVVANN 85
Ga0187911_10069260         -------E--NPAFDAVIND-----KKYALTG-----------------HH--------AGVHALVDQ 85
Ga0187910_10015336         -------ETENQ-------------KKYVVTN-----------------K-------RSNVKGLADN 155
ODAI_chimera               -------G--EAFALAKEPVNHKLVLKSG--------------------RIKAEGGPVEFDG      154
31009_GL0034153            -------D-KPVYDVVGVEKETGIINVVG--------------------TKRGINTINKKKQYAN   96
DLF014_GL0011914_          -------T-KPAYEIVDIEKNGDLIKVQ---------------------SRRCKNIESAN       136
CasR_R._albus              -------G---AFEVAERD---ESTLTLES-------------------GRi---KDKTARFKD   132
Ga0187910_10040531         -------PQAALKN---VHAPNKQKIHFIG------------------RM-----QDMNLTADH   127
tpg|DJXD01000002.1|        -------SSAGLKN---VEVS-GKKIKFQG------------------R-----HPKIATTDN    82
CasR_E._siraeum            -------D----DPAYQLNVVIMNGYSVTG------------------HR--G--ETVSAVIDN   135
PIG-018_GL0023397          -------A----NPAYEITDISSVNYSVEG------------------HR--G--QSVCATADN   135
PIG-025_GL0099734          -------E--KENFTVDTDGITDTIVPVQS------------------KR---i-ACLNTQADN    154
Ga0129317_1008067_chimera  -------SDSEKHTLKINSITDTELRLSG-------------------P--------FPKQAEAKN  83
```

FIG. 18I

```
EYZ-362B_GL0088915                         ---IS-EHSELHVLGADDLAVSFSG---------------------------TRRMK---DVSELKADN  133
uncultured_Ru_sp                           ---SSKDNSNIQLGGVNEVNITFSS---------------------------KHGFE---SGVEINTSN  133
R._flav._FD-1                              ----M--KDTPSLEVDKAESKKEISFSS------------------------HHPFV---KNDKLTTYN  133
tpg|DBYI01000091.1|                        ----L-ENEPSLKVRAADELKVTFMS--------------------------RRPFV---QESELSAVN  131

037___emb|OIZA01000315.1|                  PNK---------PDKNSGMDALCLKPYFEIDFFG--------HIF----TDNMHIQAIYNIFD        178
emb|OCTW01158726.1|                        TDK---------LSDKSGMDDLGFKRELELEVFG--------QCF---DDSIHIQIAHAVFD        131
k87_11092736                               EYES--------LISNFAESPREDYLGLKGTLERKFFG----DEY-PKDMLRIQIIYSILD         136
BMZ-11B_GL0037915                          PVND--------LIDESRKEYGQDYLMLKDQLEKVFFG----QTF-PGDNLRIQIYNILD          136
BMZ-11B_GL0037771                          TIEA--------LLINPSEKVGEDYLKLKGTLEKRFFG----REF-PHDNIRIQLIYNILD         127
BMZ-11B_GL0069617                          SLLG--------TLLNFAENDPVDYLGLKSTLEKEFFG----QEF-PNDSIRIQIIHNILD         121
Ga0099364_10024192                         GHAT--------FLNNPAEHVGIDYLKLKETLEMEFFG----KSF-PGDSVRIQIIHQILD         130
530373_GL0023589                           ------------KKTAQVVLPACSDNQLRAKDTIEQMYFG--KTY--TDNIHIQIAYNIMD         128
emb|ODAI01161274.1|                        LAYRPAGVRPDQIGAKAALEKRYFG--KET-PGDNIHVQIAYQIQD                        188
EMG_10003641                               PLFD--------QSPTAIQPNRTSGNDMIGIRRMLERKYFVHNEENKEF--QDNIRIQIAYCILD      156
CasR_F1E0_metageno                         PLHR---A-ETPRRQPLGAGMDQLRRKAILEQKYFG------RTF-DDNIHIQLIYNILD          139
emb|OIZX01000427.1|                        PLYR---R-KD--GGFVPGMDALRRKNVLEQRFFG-------KSF-ADNIHIQMYSILD           181
i60582958_gene49834                        LQD---------MYNRPHFDLLGCKNVLEQKYFG--------RTF-SDNIHVQIAYNIMD         191
gi|1198542314|gb|NFIR01000008.1|           SGNKKDDLIHCRKNLEEMYFG-----QQF---KDNIHIQLIYNILD                       189
emb|OGNF01009141.1                         PLK---------SKKTAGDDAIHSRRFLERQFFDG-------NTF---NDNIHIQLIYNILD        126
Ga0129306_1000735                          PLA---------VSRAPGQDLIGAKTALEEERYFG-------RAF---ADNIHMQVIYAIQD        137
MH0288_GL0082219                           PRA---------SQKPAGADLIGAKPALEKRYFG--------KTF---TDNIHIQLIYRILD        175
PIG-022_GL0026351                          PRE---------SQKPVGEDGIHCKRALEERYFG--------KTF---NDNIHIQLIYSILD        124
```

FIG. 18J

```
PIG-028_GL0185479          PRE-------------SQKPVGEDGIHCKRALEERYFG-------KTF--NDNIHIQLIYSILD  126
250twins_35838_GL0110300   PAN-------------FPIGRDYVKIRSALEKQYFG-------KEF-PEDNLHVQIAYNVAD  172
PIG-014_GL0226364          PAL-------------RNCGKDYIGMKNSVEKVMFG-------KEF-PNDNLHIQIAYNILD  138
250twins_36050_GL0158985   PVV-------------TNIGKDYIGLKSRLEQEFFG-------KTF-ENDNLHVQIAYNILD  176
emb|OJMM01002900.1|        PAF-------------EDCGRDYINVKSALEKRVFG-------KTY--MKDNLHVQIAYNIFD  181
emb|OGPN01002610.1|        PYF-------------KTCGKDYIGIKDVAEKYFFG-------KTF-PNENLRVQIAYNVFD  191
emb|OHCP01000044.1|        PYF-------------KVGGKDYIGIKEIAEEHFFG-------RAF-PNENLRVQIAYNIFD  186
PIG-046_GL0077813          PYS-------------NECCGKDYIGIKSVAEELFFG-------RTF-PNDNLRVQIAYNIFD  190
pig_chimera                PYS-------------NECCGKDYIGIKSVAEELFFG-------RTF-PNDNLRVQIAYNIFD  192
emb|OIEN01002196.1|        PLAKSNIRSEESALFRTRVNEYKREQKDRYETLFFG-------KTF--DDNIHIQLISKILD  136
O2.UC29-0_GL0096317        PLCGNKKQSPEAQEYSRRVLEHKKAINQKYETIVFG-------KPS--MDNIHIQVVSKIMD  136
CasR_Anaerobic_dig         PYHNV-----------KRVGEEDLRAKADLEKHYFG-------KEY--SDNLKIQIIYNILD  148
emb|OGDF01008514.1|        PLAGR-----------APVGEDAIHAKEVLEQRVFG-------KTF-SDDNIHIQLIYNILD  136
emb|OGZC01000639.1|        PLHTT--MQK-NTIKRSAGEDILQLKDVLENRYFD-------RSF--NDDLAIRLIYNILD  193
Ga0224415_10048792_chimera PLLHN-----------NSVQQDMLGLKNVLEKRYFG-------KSSGGDNNLCIQIIHNIID  133
emb|OCVV012889144.1|       PLYK------------GSVRQDMLGLKETLEKRYFN-------SAD-GTDNVCIQVIHNILD  127
Ga0187910_10066931         PLYT------------GPVQQDMLGLKETLEKRYFG-------SSVSGNDNICIQVIHNILD  129
Ga0187910_10066931         PLYT------------GPVQQDMLGLKETLEKRYFG-------ESADGNDNICIQVIHNILD  128
Ga0224415_10007274         PFYT------------GPVQQDMLGLKEILERRYFG-------SSTDGNNTICIQIIHNILD  128
Ga0187911_10069260         PQN-------------RSDAVHIRGALEKKYFG-------DTF----ADNIHVQIAYNILD  122
Ga0187910_10015336         PTKV------------ESIPGETQIGFKSILEKHFFG-------RTF--NDNIHIQIIHNILD  198
ODAI_chimera               PQKNS-----------SMSAVRLDEYNNQIERKFFRGN-----KVL--QDNIRIQIAHNIMD  198
31009_GL0034153            TQV-------------SQKRMGMDLIQRKDKLEKVFFN-------ENF--NDNIHIQLIYNILD  138
DLF014_GL0011914_          TEL-------------PFFEKIGMDLIRCKDKLEEIYFG-------RTF----NDNIHIQLIYNILD  178
```

FIG. 18K

```
CasR_R._albus              PRHI------T---VDTQGKFKEDMLGIRSVLEKKIFG--------KTF--DDNIHVQLAYNILD  178
Ga0187910_10040531         PLHSH---------DGERAVGADLLCAKDKLEQLYFG--------RTF--NDNIHIQLIYQILD  172
tpg|DJXD01000002.1|        PLFK----------PQPGMDLLCLKDKLEMHYFG----------KTF--DDNIHIQLIYQILD  123
CasR_E._siraeum            PLRRFNGRKK--DEFEQSVPTDMLCLKPTLEKKFFG--------KEF--DDNIHIQLIYNILD  186
PIG-018_GL0023397          PLHHD---------GGSSVPTDMLCLKPTLERVYFG--------KTF--DDNLHIQLIYNILD  179
PIG-025_GL0099734          FLYRK---------DSENQVQPDKLLLKDTLEKVYFG--------KTF--NDILHIQLIYNILD  199
Ga0129317_1008067_chimera  PTHK----------DNEQRNTRQDMLGLKSTLEKFYFG--------STF--DDNIHIQIIHNIQD  129
EYZ-362B_GL0088915         PLHSG---------K--NNLVPKNGTDILGLKGILEQRYYG--------RNF--DDNVHIQIIYNILD  180
uncultured_Ru_sp           PTHRS---------GESSPVRGDMLGLKSELEKRFFG--------KTF--DDNIHIQLIYNILD  178
R._flav._FD-i              PLYGG---------K--DNPEKPVGKRDMLGLKDKLEERYFG--------CTF--NDNLHIQIIYNILD  180
tpg|DBYI01000091.1|        PLHSG---------K--DKPNKSAGQDMLGLKSELEKRYFG--------KIF--DDNLHIQIIHNILD  178
                                                        .               *           :   ::     :  *

037_--_emb|OIZA01000315.1| IEKILAKHITNIIYIVNSPDRNYNQ--------SGNDTIGF-----------DLNYRV         217
emb|OCTW011587266.1|       IQKSLAAVIPNVLYITMNLDRSYST--------DNTSDKKDIIGN--------TLNYQH         174
k87_11092736               IQKILGLYVEDILHFVDGLQDEP----------EDLVGL------GLG--D               169
BMZ-11B_GL0037915          MQKAFGLYVNDVLYAVNNLQNTGRL--------LTDDDWTSDVIGL------ALG----K      178
BMZ-11B_GL0037771          IYKILGMNVADILYALGNMQDTE----------LDIDMFGQ--------SLN---N         162
BMZ-11B_GL0069617          IQKILGIYINDVLYSIANLQNVE----------TVEDCLGQ--------SLS---K         156
Ga0099364_10024192         IQKLLGIYITDIIYCINNLRDETHL--------DHESDIVGL--------SMS---N         163
530373_GL0023589           MKKIFGVYSNNIIYSINNLLEE-----------REGSDFLGV--------FYTEN           164
emb|ODAI011611274.1|       IEKLLAVYISNIIYAVNNVTGVSAM--------KDSKGRPVDLLGD-------YGILGEE      233
EMG_10003641               IEKILMPHINNICFEINNMLRL-E---------GYQEDSFMGS----------FNLYK        194
CasR_P1E0_metageno         IHKMLAVPANHIVHTLNLLGGY-----------GETDFVGM-----------LPAGL         174
```

FIG. 18L

| | | | |
|---|---|---|---|
| emb\|OIZX01000427.1\| | IHKILAAASGHIVHLLNIVNGS------------------- | ----------KDRDFIGM------------LAAHV | 216 |
| 160582958_gene49834 | IEKLLTPYINNIIYTLNELMRD------------------- | -NSKDDFFGCDSHFSVAVLYDELKA | 237 |
| gi\|1198542314\|gb\|NFIR01000008.1\| | IEKILAVQINNIVFILNNLLRW-S----------------- | ---GEEEFDLIGS---------LGVNH | 227 |
| emb\|OGNF01009141.1\| | IEKILSVHVNDIVYSVNNILSRGE------------------ | --GMEYNDYIGT--------L----NLK | 164 |
| Ga0129306_1000735 | INKILAVHANNIVTLNNLDRE-A----------------- | --DPETDDFIGS---------GYLTLKN | 177 |
| MHC288_GL0082219 | IKKVLAIHANNIVYTLDNLSRR-E----------------- | ---GTEGIDFIGI--------GGLTLKN | 215 |
| PIG-022_GL0026351 | LEKILAVHSNMIVYTFDNLRRK-E----------------- | ---TDEYDDFIGY-----------MSTVN | 162 |
| PIG-028_GL0185479 | LEKILAVHSNNIVYTFDNLRRK-E----------------- | ---TDEYDDFIGY-----------MSTVN | 164 |
| 250twins_35838_GL0110300 | IKKILSVYINNIIYMFYNLARSEEYDIFYNSQSENSGRDCDVIG | ----------SLYYQA | 222 |
| PIG-014_GL0226364 | IKKIICPYINNVVNIFYNLGRGKLK---------------- | ---DDKNDLLG------------KQIGP- | 176 |
| 250twins_36050_GL0158985 | IKKILGTYVNNIIYIFYNLNRAGTG---------------- | -RDERMYDDLIG------------TLYAYK | 218 |
| emb\|OJMM01002900.1\| | IKKIIGAYINNIIYIFYNLGREEYD---------------- | --AKKDIIG--------TQ-------- | 215 |
| emb\|OGPN01002610.1\| | IQKILGTYVNNIIYSFYNLRRDG-K---------------- | ----SDVDIIG---------SLYAFA | 228 |
| emb\|OHCP01000044.1\| | VQKILGTFVNNIIYSFYNLSRDEVQ---------------- | ----SDNDVIG---------MLYSIS | 224 |
| PIG-046_GL0077813 | IQKIFGTYINNIIYSFYNLSRDEFQ---------------- | ----SDNDVIG---------TLYMLK | 228 |
| pig_chimera | IQKILGTYINNIIYSFYNLSRDESQ---------------- | ----SDNDVIG---------TLYMLK | 230 |
| emb\|OIEN01002196.1\| | IEKTFSVVIGNIVYAIMNLSLEQS----------------- | IDRPIDIFGD-----------KNTQ---- | 174 |
| O2.UC29-0_GL0096317 | IEKTFSFVMGNIVYAINNLDFEQN----------------- | IDNPIDYMSN-----------KART---- | 174 |
| CasR_Anaerobic_dig | INKIISPYINDIVYSMNNLARNDEY---------------- | --IDGKIDVIG---------SLSSTT | 188 |
| emb\|OGDF01008514.1\| | IRKKILSTYANNVVFTINSMRRLDE---------------- | ---VDREQDYLG---------YLYTGN | 175 |
| emb\|OGZC01000639.1\| | IEKILAEYTTNAVFAIDNVSGCS------------------ | ---------DDFLS------------NFSTRN | 227 |
| Ga0224415_10048792_chimera | IEKILSEYIPNVVYAFNNIAGFKDE---------------- | -HNNIIDIIGT-----------QTYNSSY | 175 |
| emb\|OCVV012889144.1\| | IEKILAEYITNAVYSFDNIAGFG------------------ | -----EDIIGM----------GGFKPIY | 163 |
| Ga0187910_10006931 | IEKILAEYITNAAYAVNNIAGLD------------------ | ------KDIIGF----------GKFSTVY | 165 |

FIG. 18M

| Label | Sequence | # |
|---|---|---|
| R._flav_XPD_ | IEKILAEYITNAAYAVNNISGLD------KDIIGF------GKFSTVY | 164 |
| Ga0224415_10007274 | IEKILAEYITNAVYATNNIIDPD------NDVIGG------KKFISIK | 164 |
| Ga0187911_10069260 | ITKILTVYANNVVYALNNLVHADDD-----T-QADELDSLG-----NFSAGT | 163 |
| Ga0187910_10015336 | IKKILAVHTNNIVYALDNIHERGRE------NSAEKPIDMIGA------GGISTSK | 242 |
| ODAI_chimera | IEKILAVHINNIVYSVNNLFRVQG------NEGDDFLG------YRGLDK | 236 |
| 31009_GL0034153 | IEKILSVYVNNIVYALGNLERDMS------DDEKDLIG------YASTLN | 176 |
| DLF014_GL0011914_ | IEKILSVYINNAVYALGNLERKEN------DKEKDLVG------YLSARA | 216 |
| CasR_R._albus | VEKIMAQYVSDIVYMLHNTDKTER------NDNLMG------YMSIRN | 214 |
| Ga0187910_10040531 | IQKILALHANNIIFALDNLLHKKN------DELSDDFVGM------GRMRATI | 213 |
| tpg\|DJXD01000002.1\| | IEKILAVHVNNIVFTLDNVLHPQK------EELTEDFIGA------GGWRINL | 164 |
| CasR_E._siraeum | IEKILAVYSTNAIYALNNMSADEN------IENSDFFM------KRTTDE | 224 |
| PIG-018_GL0023397 | IEKILAIYSTNAVYALNNMIADED------DESSDLFQ------NMTIDY | 217 |
| PIG-025_GL0099734 | IQKILTVYSVNTVYTLNNLFGKEI------SERGDFIG------ALSFQQ | 237 |
| Ga0129317_1008067_chimera | IAKILAAHSNNAGYALDNMLAYQG------VEFSDMIG------YMGTSR | 167 |
| EYZ-362B_GL0088915 | IEKNLAIYVTNVVAALDHMCDEIL------DTEHEDFIG------YMNTMN | 219 |
| uncultured_Ru_sp | IEKILAVYVTNIVYALNNMLGVKG------SESHDDFIG------YLSINN | 217 |
| R._flav_FD-1 | IEKILAVHSANITTALDHMVDEDDE------KYLNSDYIG------YMNTIN | 220 |
| tpg\|DBYI01000091.1\| | IEKILAVYATNITAAIDHMVDDDNE------QYLQGDFIG------YMNTLN | 218 |
| | : * : . . . . | |
| 037_---_emb\|OIZA01000315.1\| | PYLEYGGGKDSNGK------PNKISAWKKRENFINFYN------EAKPHLGY- | 257 |
| emb\|OCTW01158726 6.1\| | SYESFNVE------KRGEFTEYYN------AAKDRFSY- | 200 |
| k87_11092736 | ------EKMQKLLS------KALPYMGF- | 185 |
| BMZ-11B_GL0037915 | ------GRGKEIIE------SMSDALGF- | 194 |

FIG. 18N

| Sequence ID | Sequence | Position |
|---|---|---|
| BMZ-11B_GL0037771 | ---------------------------------P---EKAKDVQ------RMKPYMGF- | 179 |
| BMZ-11B_GL0069617 | ----------------------------------GQDEKLKKILN------SITPYLGF- | 175 |
| Ga0099364_10024192 | ----------------------------------TNVNLALN------QMRPYFGF- | 184 |
| 530373_GL0023589 | SYQAMNFADAI------IKSKLLTKNSKYLNLDMNNVWF--NK-EVSELSSFRKYV- | 211 |
| emb\|ODAI011611274.1\| | GLTKRLQRIPE------Q------ADEEAKALQAFL------CSERLSY- | 264 |
| EMG_10003641 | PYDAFIATTDD------KE------SSRRDNFAKLM------TSKQVRY- | 225 |
| CasR_P1E0_metageno | PYDKLRVKKK------NGDT------VDIKADIAAYA------KRPQLAY- | 207 |
| emb\|OIZX01000427.1\| | LYNELNEEA------------------KRSIADFC------KSPRLIY- | 240 |
| 160582958_gene49834 | GYSDRLKTKPN------LS------KNIDRIWNNFCNYMN-SDSGNTEARLAY- | 277 |
| gi\|1119854231\|gb\|NFIR01000008.1\| | TYEEFKGRNK------------------NYGKFSELI------KQSQMRY- | 253 |
| emb\|OGNF01009141.1 | SFETYKNNLV------------------NKKKFDLDRVK------KIPQLAY- | 192 |
| Ga0129306_1000735 | TFETYCDPAAL------NER------EREKVTVSKQHFDAFM------QNPRLAY- | 214 |
| MH0288_GL0082219 | SYAAYCEPRTF------FDEGKEKNIIENIEKSHGEFLEYM------KNPRLAY- | 257 |
| PIG-022_GL0026351 | SYEEFMNPEKL------L-PGKDQSVYDNINRSRETFLEYR------KNPRLGY- | 203 |
| PIG-028_GL0185479 | SYEEFISPEKL------L-PGKEQSVYDNINRSQETFLEYR------KNPRLGY- | 205 |
| 250twins_35838_GL0110300 | SYRNQDANRFE------KD---GKKKAIDSLLD------DTRAYYTY- | 254 |
| PIG-014_GL0226364 | ------------------KSEEMVEDLLK------NSSAYFVY- | 195 |
| 250twins_36050_GL0158985 | PMEAQQTYLLK------GDKDMRRFEEVKQLLQ------NTSAYYVY- | 253 |
| emb\|OJMM01002900.1\| | ------------------DSAYISKILN------NTSAYFTY- | 233 |
| emb\|OGPN01002610.1\| | DFDMQLKDK------PAFREAKDLLK------NTEAYFSY- | 256 |
| emb\|OHCP01000044.1\| | DYDRQKET------ETFLQAKSLLK------QTEAYYAY- | 251 |
| PIG-046_GL0077813 | DFDGQKET------DTFRQARALLE------RTEAYYSY- | 255 |
| pig_chimera | DFDGQKET------DTFRQARALLE------RTEAYYSY- | 257 |
| emb\|OIEN01002196.1\| | ------------------GISLREDNDYLK------TMLPRCEYL | 195 |

FIG. 18O

| | | |
|---|---|---|
| O2.UC29-0_GL0096317 | ------------------------------DENLK------RVLRRCMYL | 188 |
| CasR_Anaerobic_dig | DYSSFMSPNKD------LEKEKKFSFHRENYKKFVE------ASKPYMRY- | 226 |
| emb\|OGDF01008514.1\| | SYERLLDIADKYAVDGEDWRNTAAGISNDFEKKQFQTINGFWDLLD------MIEPYMCY- | 229 |
| emb\|OGZC01000639.1\| | QWDEFQNPEQH------REHF------GNKDNVICSVKKQQDLFFNFFK------NNRIGY- | 270 |
| Ga0224415_10048792_chimera | TYADFSKDKSD------K------KYIEFQKLLK------NKRLGY- | 203 |
| emb\|OCVV01288914.1\| | TYKQFKEPDK------YNKKFDDILN------NSRLGY- | 189 |
| Ga0187910_10006931 | TFDEFAEPDRH------KERFIKDGKLDTKLINQLKNQYDEFDAFLD------DTRFGY- | 212 |
| R._flav_XPD_ | TYDEFKDPEHH------RAAFN------NNDKLINAIKAQYDEFDNFLD------NPRLGY- | 207 |
| Ga0224415_10007274 | TFAQFSASD------SSNDFEQFLK------NPRLGY- | 189 |
| Ga0187911_10069260 | SVAKSKSKSKS------KQQDFVELFI------KKKEIHGY- | 192 |
| Ga0187910_10015336 | EYEQYCSEKSD------YEDNFLKQLI------NNERIAV- | 270 |
| ODAI_chimera | NYSDFCKNKPE------DKERFFNFIGKGDGKVTNPRLSY- | 270 |
| 31009_GL0034153 | SYEDFIMKNL------VKQNENLDKFIE------NGNRLGY- | 205 |
| DLF014_GL0011914_ | GYNKVINKAIN------DEKIKDRIEDLKEFIE------NGNRLGY- | 250 |
| CasR_R._albus | TYKTFCDTSN------LPDDTKQKVENQKREFDKIIK------SGRLGY- | 251 |
| Ga0187910_10040531 | GYDAFRNSTNQ------KVQETYREFQEFVR------RKELLY- | 244 |
| tpg\|DJXD01000002.1\| | DYQTLRGQTN------KYDRFKNYIK------RKELLY- | 190 |
| CasR_E._siraeum | TFDDFEKKKES------T------NSREKADFDAFEKFIG------NYRLAY- | 258 |
| PIG-018_GL0023397 | TYDKFRGRSE------RIVKSFNDFVS------NPRLAY- | 244 |
| PIG-025_GL0099734 | TYDDYISDSKN------KEIFEDFYS------KRSLGY- | 263 |
| Ga0129317_1008067_chimera | TFDNYDPNHKN------NKDFFRFLK------LPRLGY- | 193 |
| EYZ-362B_GL0088915 | SFDVFMHFSQS------SRADIYKKINDSRRRFENLLR------TKRLGY- | 257 |
| uncultured_Ru_sp | IYDVFIDPDN------S------SLSDDKKANVRKSLSKFNALLK------TKRLGY- | 256 |
| R._flav_FD-1 | TYDVFMDPSKN------S------SLSPKDRKNIDNSRAKFEKLLS------TKRLGY- | 260 |

FIG. 18P

| | | |
|---|---|---|
| tpg\|DBYI01000091.1\| | TYEVFMEFSKN--------P--------RLDSMARKNIEMSREKFEYLLD--------TQRLGY-- | 258 |
| 037__emb\|OIZA01000315.1\| | YENIFYDHG------------------------------------------------------- | 266 |
| emb\|OCTW011587266.1\| | FPDILCVLEKVNGKDR------------------------------------------------ | 216 |
| k87_11092736 | FGSTDVFKVTKKRE-------------------------------------------------- | 199 |
| BMZ--11B_GL0037915 | FGSAFKPIPKKPGDKTSGKYAGGKLKER------------------------------------ | 222 |
| BMZ--11B_GL0037771 | FGGIFRTQKKEDRKKDSNLSEEEKEEKKKK---------------------------------- | 209 |
| BMZ--11B_GL0069617 | LGAGFKQSERPKHQKNSRPDPRQKIE-------------------------------------- | 201 |
| Ga0099364_10024192 | FGEAFRPVGDDKVKEITLSDEVRKNIEKIIALEEQKRNPSTPRFKQENINLEIENAMGKF----- | 244 |
| 530373_GL0023589 | YSRSYANKTSTAKKICICLQEDFHFFDYA-----------TVKKAADQFTLLKRIQRS------ | 258 |
| emb\|ODAI011611274.1\| | FGKEFCLVRNSFKQF------------------------------------------------- | 279 |
| EMG_10003641 | LGNALYSDSLSNLTKDE----------------------------------------------- | 242 |
| CasR_P1E0_metageno | LGAAFYETLDNGK--------------------------------------------------- | 222 |
| emb\|OIZX01000427.1\| | YSAAFYETLDNGK--------------------------------------------------- | 253 |
| 160582958_gene49834 | FGELFYKPKETGDAK-----------------------------------------------S- | 293 |
| gi\|1198542314\|gb\|NFIR01000008.1\| | FGSTFCLFNENEERITS----------------------------------------------- | 270 |
| emb\|OGNF01009141.1 | FGSAFYNTPEDTSAK------------------------------------------------- | 207 |
| Ga0129306_1000735 | YGNAFFRKLSKAERLARG--------REIFDK--------------ESPERRQEILGSRGKN-- | 254 |
| MH0288_GL0082219 | YGEAFYRRLSNNERSKLGMERYERMSDA--------------QRDAFDRKYPIDFCDG------ | 301 |
| PIG-022_GL0026351 | FGKVFYEKVTDPKNK------------------------------------------------- | 218 |
| PIG-028_GL0185479 | FGKVFYEKSTDAKDK------------------------------------------------- | 220 |
| 250twins_35838_GL0110300 | FDGLFSVFKREDDGKI------------------------------------------------ | 270 |
| PIG-014_GL0226364 | FGDVFKQVKLSKEQQE------------------------------------------------ | 211 |

FIG. 18Q

| | | |
|---|---|---|
| 250twins_36050_GL0158985 | YGTLFEKVKAKSKKEQ | 269 |
| emb\|OJMM01002900.1\| | FDGVFKQITDRDSNK | 248 |
| emb\|OGPN01002610.1\| | FGDVFKKSKKGKKDE | 271 |
| emb\|OHCP01000044.1\| | FDDVFKKNKKPDKNKE | 267 |
| PIG-046_GL0077813 | FDNVFKKIDKKKRN | 270 |
| pig_chimera | FDNVFKKIDKNKKS | 272 |
| emb\|OIEN01002196.1\| | FHNILNSDSDNNSKMN | 211 |
| O2.UC29-0_GL0096317 | FDLGFEYAEPSPYKKS | 204 |
| CasR_Anaerobic_dig | YGKVFIRDVKKKSLST | 242 |
| emb\|OGDF01008514.1\| | FSEAFFCETTVKDPDS | 245 |
| emb\|OGZC01000639.1 | FGKAFFHAESE | 281 |
| Ga0224415_10048792_chimera | WGKAFFTGQGN | 214 |
| emb\|OCVV012889144.1\| | YGKAFFEKNDLKHNPN | 205 |
| Ga0187910_10006931 | FGKAFFCKEGD | 223 |
| R._flav_XPD_ | FGQAFFSKEGR | 218 |
| Ga0224415_10007274 | LGKAFFYKDGK | 200 |
| Ga0187911_10069260 | FGDTFAFLDKRI | 204 |
| Ga0187910_10015336 | FGNAFFKDEGNK | 282 |
| ODAI_chimera | YGAAFAEKVQPT | 282 |
| 31009_GL0034153 | FGNVFYKNKNE | 216 |
| DLF014_GL0011914_ | FGDIFFKKEEVSKNGK | 266 |
| CasR_R._albus | FGEAFMVNSGNS | 263 |
| Ga0187910_10040531 | FGSAFYNGDT | 254 |
| tpg\|DJXD01000002.1\| | FGEAFYHENE | 200 |

FIG. 18R

```
CasR_E._siraeum                         FADAFYVNKKNPKGK--------------------------------------------------------  273
PIG-018_GL0023397                       YSDAFYEKKGKG-----------------------------------------------------------  256
PIG-025_GL0099734                       YGHIFFKDKK-------------------------------------------------------------  273
Ga0129317_1008067_chimera               FGSAFYSQKG-KD----------------------------------------------------------  205
EYZ-362B_GL0088915                      FGFAYNPKDR-------------------------------------------------------------  267
uncultured_Ru_sp                        FGLEEPKTKD-NR----------------------------------------------------------  268
R._flav._FD-i                           FGFDYDANGKDKK----------------------------------------------------------  273
tpg:DBYI01000091.1|                     LSLEYDKRSKDKR----------------------------------------------------------  271

037_--_emb|OIZA01000315.1|              ---------------------EPISEEKFVNYLNILNFIRNNTFHYKDN----------------------  294
emb|OCTW01158726 6.1|                   --------------------YQPKSEKDAFNVLSSVNMLRNSLFHFAPKSND--------------GKA   251
k87_11092736                            --------------------ERAAADERNAKVFRALGAIRQKLAHFKWK----------------E     229
BMZ-11B_GL0037915                       ---------------------DAAIAEDVAVLRVLCGLRQISAHFRSEKKG---------------E    253
BMZ-11B_GL0037771                       --------------------QEELLQKDLQHNMDVARCISALRHATAHNKPATAHDK---------QDE  249
BMZ-11B_GL0069617                       ----------------------DPNWAYNKSALRILSTLRNKLAHFEDS--------------------  228
Ga0099364_10024192                      KSKDAFETAKKKYNRIVADETNAKTLRILGAMRQITAHFKDQ---------------------------  286
530373_GL0023589                        NYFFDMLCDSAGNYQ-----CKNAQILLSILGNLRQESFHENRS--------------------T      298
emb|ODAI01161127 4.1|                   --------------------DKEEKRQYKLMRVLCLLGELRQFLVHGKKK--------------EKE   312
EMG_10003641                            ----------------------ILDGKRSKELKKYYQELCLLGMVRQSMIHSNQF--------------  275
CasR_P1E0_metageno                      --------------------DAARGRVKREQDVYAILSLMSLLRQFCAHDSVRIWG---------QNT  261
emb|OIZX01000427.1|                     --------------------SERRSNEDIFNILALMTCLRNFSSHHSIAIKVK----------DYS   289
160582958_gene49834                     DYKTHLSNNQKEEWELKSDKEVYNIFAILCDLRHFCTHGESIT--------------------PSG    339
gi|119854 2314|gb|NFIR01000008.1|       -------------------ENKKEWKRFEKKCYHLLAVLGMMRQATAHGDSK--------------R   304
```

FIG. 18S

```
emb|OGNF01009141.1          ------------------ITKTKIKSNEEIYYTFMLLSTARNFSAHYLDRNRAKS------SDAEDFDGT  253
Ga0129306_1000735           KSVDDEIRALAPEWVKREERDVYSELVLMSELRQSCFHGQQK------------------------N    297
MH0288_GL0082219            ELHFREIEKLAPEYVRKSEKEIYYILAMLSELRQCVFHDSAA------------------------S    344
PIG-022_GL0026351           ------SKKKMRLISEKEMYYIFALLGGLRQFCTHDKNR----------------------------A    252
PIG-028_GL0185479           ------NKKKMRLISEKEMYYIFALLGGLRQFCTHDKNR----------------------------A    254
250twins_35838_GL0110300    ------KESEKEKAKDQNFDVLRLLSVGRQLIFHSDKSNNE------------------------     305
PIG-014_GL0226364           ----KSEEEKRRIWQELWNKNFDHNKNIVNSLIKFRQMCFHQNYENSD-------------KEVS     259
250twins_36050_GL0158985    ------RAKEAEIDACTAHNYDVLRLLSLMRQLCMHSVAGTAF--------------------KLA     309
emb|OJMM01002900.1|         ------DREIKNSYNALVLKVLYLYLRQFCMHGNTYTKR-----------------------NEESFLS  287
emb|OGPN01002610.1|         ------NNEDYEKNLRHNFNVLRVLSFLRQICTHAYVKCTGGAKNNGDSTKVEAES             321
emb|OHCP01000044.1|         ------GDNSKQYQENLRHNFNILRVLSFLRQICMHAEVHVSD--DEGCTRIQNYTDS             317
PIG-046_GL0077813           ------DDYEGKRNEILRYNFNVLRVLSFLRQICAHAKVKVSS--DNDREKGGVFVDS             320
pig_chimera                 ------DDCKRERNEILRYNFNVLRVLSFLRQICAHAQVKISN--EHDREKGGGLVDS             322
emb|OIEM01002196.1|         YNKVNKGKEEKDNRRNENIEKLKKALEVIKIIRVDSPHGVDGIKGD-------------QKF     260
O2.UC29-0_GL0096317         EQ---QIEQRREERBKENLETLKKALDVISVMRTDSFHGYDMCNSTS-------------AIVKF     253
CasR_Anaerobic_dig          ------GKGEKIEVMYRSDEEIFTIFQILSYVRQSIMHNDI---------------------GN     279
emb|OGDF01008514.1|         ------GRIVPCLEQRSDGDIYNILRILSIVRQTCMHDNA-----------------------SM    281
emb|OGZC01000639.1          ------RKIVKKTEKEVYHILTLIGSLRQWITHSTEG--------------------------GIS    315
Ga0224415_10048792_chimera  ------NAKVRQENQCFHIIALLISLRNWATHSNELDK-------------------------HTK    249
emb|OCVV012889144.1|        ----KKKRDKNPYILKYDNECYYIIALLSGLRHWNIHSHAKDD------------------LVS     247
Ga0187910_10065931          ------KYLNKQDNERYHILALLSGLRNWVVHNNEVES-------------------------KID    258
R._flav_XPD                 ------NYIINYGNECYDILALLSGLRHWVVHNEEES--------------------------RIS    253
Ga0224415_10007274          ------RNNRQKDPIECYHLLALLCGLRNWVVHNNEEKD-------------------------LIK    236
Ga0187911_10069260          ------ADADKEKQVYAMLACLGSLRQACSHYRIRYSVNG-----------------KNVDADA      245
```

FIG. 18T

| Ga0187910_10015336 | ----------------------------------------KVMRTEKEIYYILGMLNEVRNVSTHFTEEDN----------------------RDWA | 317 |
| ODAI_chimera | -----------------------------------------LKYREAEDIYYIICMLGEARQMFAHGND---------------------DRT | 313 |
| 31009_GL0034153 | ----------------------------------------LKDKKDIFDMLCLLGSLRQFCFHFKGAKFEGV---------------EQIS | 252 |
| DLF014_GL0011914_ | ----------------------------------------KPKKVEVLKSEKEIFDILALLGSLRQFCFHYDEAVFENEDGV----IDKEYND | 315 |
| CasR_R._albus | ----------------------------------------TKLRPEKEIYHIFALMASLRQSYFHGYVKDT---------------DYQG | 298 |
| Ga0187910_10040531 | ----------------------------------------RRDEKVYHILSLAASVRQFCFHNDYTSDDGK-----------------GFIK | 290 |
| tpg|DJXD01000002.1| | ----------------------------------------RRYEEDIFAILTLLSALRQFCFHSDLSSDES-----------------DHVN | 235 |
| CasR_E._siraeum | ----------------------------------------AKNVLREDKELYSVLTLIGKLRHWCVHSEE-------------------GRA | 306 |
| PIG-018_GL0023397 | ----------------------------------------SKRRSEKEIYSMLAMLGKLRHWCVHSES-------------------GEA | 287 |
| PIG-025_GL0099734 | ----------------------------------------KRSKREIYDILALIATIRQWCIHSEE--------------------DK | 301 |
| Ga0129317_1008067_chimera | ----------------------------------------FEKRSDEEVNICALMGQIRQCCFHGKQ-------------------EKYQ | 237 |
| EYZ-362B_GL0088915 | ----------------------------------------NQKRLYLMSMIGQLRQFAPHKDS---------------------PFN | 295 |
| uncultured_Ru_sp | ----------------------------------------VSQAYKKRVYHMLAIVGQIRQCVFHDKS---------------------GAK | 299 |
| R._flav._FD-1 | ----------------------------------------KNEEIKKRLYHLTAFAGQLRQWSFHSAG---------------------NYP | 304 |
| tpg|DBYI01000091.1| | ----------------------------------------KSEEIKKRLYHLVAFAGQLRQWSFHSVE---------------------GLP | 302 |
|  | * * |  |
| 037_-_emb|OIZA01000315.1| | DIELYSENYS-E-------------------EYVFINCLNEFVKNKFKNVNKN-F | 328 |
| emb|OCTW01158766.1| | RIAVFKNQFDSD-------------------FSHITSTVNKIYSAKIAGVNEN-F | 286 |
| k87_11092736 | SLAIFGANANMPI------------------RFFQGATGGRQLWNDVIAPLWKKRIERVRKS-F | 274 |
| BMZ-11B_GL0037915 | SLWASDLGVEK-------------------YFKNEM--SVVDANYKARAKKIDAN-F | 288 |
| BMZ-11B_GL0037771 | YPWFKSSDIYET------------------KIFKAGMW--SVIEADYKKKIQDVNKQ-F | 287 |
| BMZ-11B_GL0069617 | --SILFCDNLKG---------------Q--FLGSNGNW--ITIETHYDEMITRINES-F | 265 |
| Ga0099364_10024192 | --ATLFMSDVELPK---------ILK--KEFSKADW-QTVEDYYAKLVDRINEG-F | 327 |

FIG. 18U

| | | |
|---|---|---|
| 530373_GL0023589 | SAWMFNLEKVLT----------------------PERKKLLTALIDSRTNHINN--HF | 332 |
| emb\|ODAI01161l274.1\| | FAWLYRLDRQLS----------------------QEYRKLLGEFYDAQVDKVNK--SF | 346 |
| EMG_10003641 | NSSIYTLDSSYDSTMNTAELLGKGDDSSLVALATDARVEARAILDEIYKKGVDSINN--SF | 334 |
| CasR_P1E0_metageno | TAALYHLQALP-----------------------QDMKDLLDDGWRRALGGVND-HF | 294 |
| emb\|OIZX01000427.1\| | AAGLYNLRRLG-----------------------PDMKKMLDTFYTEAFIQLNQ--SF | 322 |
| 160582958_gene49834 | KPFPYNLEKNLF-----------------------PEAKQVLNSLFEEKAESLGAEAF | 374 |
| gi\|111985423l4\|gb\|NFIR01000008.1\| | RAEIYKLGKEFDRL-----------------EARGCRPEARKELDELYKKIHEMNQ-GF | 346 |
| emb\|OGNF01009141.1 | SVIMYNLDNEELYK-------------------KLYNKKVHMALTGMKKVLDANFNKKVEHLNN-SF | 300 |
| Ga0129306_1000735 | SARIFRLDNDLG-----------------------PGVDGARELLDRLYAEKINDLR----SF | 333 |
| MH0288_GL0082219 | RSWLYNLEKVLP-----------------------AEAMQVLDGVYSQKVAALN----NF | 377 |
| PIG-022_GL0026351 | RNWLYSLDTMLN-----------------------DDAKAVLDKYVSTVSSLNK--HF | 286 |
| PIG-028_GL0185479 | RNWLYSLDTMLN-----------------------DDAKAVLDKYVSTVSSLNK--HF | 288 |
| 250twins_35838_GL0110300 | -AYLFDLSKLTRA-----------------AQDENRRQDIQSLLNLNSTCRSNLEGVNGD-F | 349 |
| PIG-014_GL0226364 | STALFNIEQFL----------------------NKEEKASLDEIYTGAIDKVNCD-F | 293 |
| 250twins_36050_GL0158985 | ESALFNIEDVL-----------------------SADLKEILDEAFSGAVNKLNDG-F | 343 |
| emb\|OJMM01002900.1\| | DTALYNAKEFFAK-----------------ADPQINELIDAVYADGIKTINSD-F | 324 |
| emb\|OGPN01002610.1\| | LDALFNITEYFAK------------------TAPELSKTINEIYKEGIDRINND-F | 358 |
| emb\|OHCP01000044.1\| | LEALFNISKAFGK-------------------KMPELKTLIDNIYSKGINAINDE-F | 354 |
| PIG-046_GL0077813 | LDALFNISSFFDA-----------------------VAPELNEVINSVYSKGIYDINDN-F | 357 |
| pig_chimera | LDALFNISRFFDA-----------------------VAPELNEVINSVYSKGIDDINDN-F | 359 |
| emb\|OIEN01002196.1\| | PRSKYNLAVN-----------------------YNEEIQKTISEPFNRKVEEVQQD-F | 294 |
| O2.UC29-0_GL0096317 | PSKKFNLDQ-----------------------KGKNLIYRNAFKYKTDTIKKQ--Y | 284 |
| CasR_Anaerobic_dig | KSSILAIEK-----------------------YPARFVGFLSDLLKTNDVNRM-F | 312 |
| emb\|OGDF01008514.1\| | RTVMFTLGQNSVR----------------------DRKNGFDELAELLDYLYDEKIDIVNRD-F | 322 |

FIG. 18V

```
emb|OGZC01000639.1          RLWLYQLEDA-------------LSREYQETMNNCYNSTIYGLQKD--F  349
Ga0224415_10048792_chimera  RTWLYKLDDTNI-----------LNAEYVKTLNYLYDTIADELTKS--F  285
emb|OCVV012889144.1|        YRWLYNLDSI-------------LNREYISTLNYLYDDIADELITES--F  281
Ga0187910_10006931          RKWLYNLDKN-------------LDKEYITTLDYMYSDIADELITKS--F  292
R._flav_XPD_                RTWLYNLDKN-------------LDNEYISTLNYLYDRITNELTNS--F  287
Ga0224415_10007274          YTWLYNLDKY-------------LDAEYITTLNYMYNDIGDELIDS--F  270
Ga0187911_10069260          DTWLFSSAQLDQ-----------TDPLFSEMLNRIYSHKIKTVNQN--F  281
Ga0187910_10015336          KANLYNLSNR-------------LKVGSKEVLNQLYKEKIDKIDANGF  352
ODAI_chimera                KTFLYNIVGYRN-----------GTEINSKFTAVLDGIYSKKVEELNGN--F  352
31009_GL0034153             NSWLYNLSQ--------------LHNEFKSTLDSFYNEKIEDINGN--F  285
DLF014_GL0011914_           NSWLYNLEK--------------LEFEFKDTLDYFYNRKINDINKG--F  348
CasR_R._albus               TTWAYTLEDRLK-----------GPSHEFRETIDKIFDEGFSKISKD--F  335
Ga0187910_10040531          ADWMYRLEEA-------------LPAEYKDTLDALYLEGVEGLDQS--F  324
tpg|DJXD01000002.i|         SFWLYQLEDQ-------------LSDEFKETLSILWEEVTERIDSE--F  269
CasR_E._siraeum             EFWLYKLDE--------------LKDDFKNVLDVVYNRPVEEINNR--F  339
PIG-018_GL00023397          EFWLYKLDS--------------LNGEFIDVLNTLYNRSVNEINKG--F  320
PIG-025_GL0099734           KTWIYNAENV-------------LDSEYLDILDDVYGGLVERINKN--F  335
Ga0129317_1008067_chimera   LKRWLYNFHNFK-----------SNKPFLDTLDKHFDEMIDRINKN--F  272
EYZ-362B_GL0088915          RVWLYQLDEK-------------LSKEHKDTLNYFFDQRYDEIHEN--F  329
uncultured_Ru_sp            RFDLYSFINN-------------IDPEYRDTLDYLVEERLKSINKD--F  333
R._flav_FD-1                RTWLYKLDS--------------LDKEYLDTLDHYFDKRFNDINDD--F  337
tpg|DBYI01000091.1|         RTWIYQLDNPK------------LAQEYRDTLDYFFNERFDAINKD--F  337
```

FIG. 18W

| ID | Sequence | Position |
|---|---|---|
| 037_-_emb\|OIZA01000315.1\| | I-SNE-KNNLYIILKAYGEDTENVEVVKKYSKELYKLSVLKTNKNLGVNVKKLRESAIEY | 386 |
| emb\|OCTW01587266.1\| | L-NNE-GNNLYIILKAINWD------IKKIVPQLYRFSVLKSDKNMGFNMRKLREFAVES | 338 |
| k87_11092736 | L-SNS-AKNLWVLYQVFKDDID--EKKKARARQYYHFSVLKEGKNLGFNLTKIREYFLDK | 330 |
| BMZ-11B_GL00037915 | M-ATS-RANLVLLFRILNAKTK--EEKEKIAVDYIKFAIRKEGKNLGVNLKKAREILLDK | 344 |
| BMZ-11B_GL00037771 | F-SKN-KVNLAILFDLLDVRDV--KQKKRISDEFYRFTIRDGKNLGWNLVKIREIIIDR | 343 |
| BMZ-11B_GL00069617 | F-NNS-RMNLKILYLVLNAATL--EDKKKITEEYYRFSILKEGKNLGVNMRKLREMMVDM | 321 |
| Ga0099364_10024192 | C-KNA-ATNVHFLTELLPE------ESKKQLTEDYPRFAILKEGKNLGVNMKRLREVMFAL | 380 |
| 530373_GL00023589 | I-ENS-NKNLNAIFRLFPEKS------QADLIVEYYDFSVRKAYKNLGFSVKLLREMLLKT | 385 |
| emb\|ODAI01611274.1\| | L-TNS-TVNLEVLFRALKTGTD--PERKIVTQEYYQFTVRKEDGNLGFSLKTLREILLSA | 402 |
| EMG_10003641 | L-SNS-INDLENLFKIYKCDSS--EKKTELIKQYYDFCIRKFQMNMGFSITTIREGMFTR | 390 |
| CasR_P1E0_metageno | L-DTN-KVNLLTLFEYYGAETK--QARVALTQDFYRFVVLKEQKNMGFSLRRLREELLKL | 350 |
| emb\|OIZX01000427.1\| | Q-DHN-TINLICLFDILNISDS--ARQKQLAEEFYRYVEKEQKNLGFSVRKLREEMLLL | 378 |
| 160582958_gene49834 | G-KTAGKTDVSILLKVFEKEQASQKEQQALLKEYYDFKVQKTYKNMGFSIKKLREAIMEI | 433 |
| gi\|1198542314\|gb\|INFIR01000008.1\| | L-KNS-KSDILMLFRIYNAESK--EAKRRLAQEYYEFIMLKSYKNTGFSIKHLRETMIDK | 402 |
| emb\|OGNF01009141.1 | I-KNS-AKDFVILCEVLGIKSR--DEKTKFVKDYDFVRKNYKHLGFSVKELRELLFAN | 356 |
| GaG129306_1000735 | D-KTSASSNFRLLFNAYHADN--EKKKELAQEFYRFSVLRKNTGFSIRTLREKIIED | 389 |
| MH0288_GL0082219 | S-KTSSKSNFRLLFNALHADTD--AQKKQIAEDFYKFSVRKTYKNIGFSIKLLRESMLDT | 434 |
| PIG-022_GL00026351 | V-DNSAKKDFSIIFNALNITDI--ELKKNIAKEYYEFVCRKNFKNIGFSIKKLREYLLEK | 343 |
| PIG-028_GL0185479 | V-ENSAKKDFSIIFNALNITDI--ELKKNIAKEYYEFVCRKNFKNIGFSIKKLREYLLEK | 345 |
| 250twins_35838_GL0110300 | V-KHA--KNNLYVLNQLYPS------LKANDLIGEYYNFIVKKENRNIGIRLITVRELIIEH | 402 |
| PIG-014_GL02226364 | N-KNS-SNNLYILEQIYCN------D--KNLGQRYYDFVVKKSQCNLGLDTKLIRELLIRK | 344 |
| 250twins_36050_GL01158985 | V-QHS-GNNLYVLQQLYFN------ETIERIAEKYYRLIVRKEDLNMGVNIKKLRELIVGQ | 396 |
| emb\|OJMM01002900.1\| | M-AHA-KNNMYIICEVYKN------EAEDSLMKEYYDFVVRKEGNNLGFNTRQLREILIDK | 377 |
| emb\|OGPN01002610.1\| | V-TNG-KNNLYILSKVYPD------MQRNELVKKYYQFVVCKEGNNVGINTRKLKESIISQ | 411 |

FIG. 18X

```
emb|OHCF01000044.1|        V--KNG--KNNLYILSKVYPN--------EKREVLLREYYNFVVCKEGSNIGISTRKLKETMIAQ   407
PIG-046_GL0077813          V--KND--KNNFYILSKIYPE--------VARENLLKEYYYFVVSKEGNNIGISTKKLKEAIIAQ   410
pig_chimera                V--KNG--KNNFYILSKIYPE--------VAREDLLREYYYFVVSKEGNNIGISTKKLKEAIIVQ   412
emb|OIEN01002196.1|        Y--RNS--CVNIDFLKEIMYGSNYTDRGSDSLECSYFNFAILKQNKNMGFSITSIRECLLDL     352
O2.UC29-0_GL0096317        A--QNS--KVNINFLSYVLYGNGCTEEQKKELSREYFNFAILKQYKNLGFSITSLREQLLSL     342
CasR_Anaerobic_dig         IDNNS--QTNFWVLFSIFGL-QDHTSGADKICRNFYDFVIKADSKNLGFSLKKIRELMLDL      370
emb|OGDF01008514.1|        L--RNQ--KNNIELLSRIYGS-SADSPERDRLVQNFYDFRVLSQDKNLGFSIKKLREKLLDS     379
emb|OGZC01000639.1|        E--KTN--APNLNFLAEILGK--N--------ASELAEPYFRFIITKEYKNLGFSIKTLREMLLDQ 401
Ga0224415_10048792_chimera S--KNG--AVNVNYLAKKYNI--K--------DDLPGFSEQYFRFSIMKEQKNLGFNISKLRENMLDF 339
emb|OCVV01288914.1|        S--KNS--SANVNYIAETLNI--D---------PSEFAQQYFRFSIMKEQKNMGFNVSKLREIMLDR  333
Ga0187910_10006931         S--KNS--AANVNYIAEILNI--D---------SKTFAEQYFRFSIMKEQKNLGFTLTKLRECMLDR  344
R._flav_XPD_               S--KNS--AANINYIAETLGI--N---------FAEFAEQYFRFSIMKEQKNLGFNITKLREVMLDR  339
Ga0224415_10007274         S--KNS--AANINYIAETLGI--D---------FKTFAEQYFRFSIMKEQKNLGFNLTKLREVMLDR  322
Ga0187911_10069260         FENNR--KANFPILKKMYPE---------TTLKVLMNEYYDFSIRKGYKNFGFSIKSLREALLSP   335
Ga0187910_10015336         VNKGC--KRDFSILFKSLNL--T-TDKDKGELVVGFYDFSIRKNYKNIGFSIKTLREYMLKI       409
ODAI_chimera               I--KNS--KKDLTILFSAFGC-Q-DEASKKKLIEKYDFIVKKTNKNMGFSVTKLREKIIEG     408
31009_GL0034153            I--EKN--KVNIQILCNDLKL---------DKNKLVQDYYNFLISKNHKNMGFSIKKIREYILDI    337
DLF014_GL0011914           I--KTN--QINLHIICDELGL--N---------WDKEQVVGDYYDFLIAKKYKNIGFSIKKIREHMFDI 402
CasR_R._albus              G--KMN--KVNLQILEQMIGE--LYGSIERQNLTCDYYDFIQLKKHKYLGFSIKRLRETMLET     392
Ga0187910_10040531         L--KNN--TVNIQILCSIFNH---------DDPNKIAEEYYGFLMTKEYKNMGFSIKKLRECMLEL    377
tpg|DJXD01000002.1|        L--KTN--TVNLHILCHVFPK---------ESKETIVRAYYEFLIKKSFKNMGFSIKKLREIMLEQ   322
CasR_E._siraeum            i--ENN--KVNIQILGSVYKN---------TDIAELVRSYYEFLITKKYKNMGFSIKKLRESMLEG   392
PIG-018_GL0023397          V--DTN--KVNIQLQAVCKN----------MDLSLIKAYYEFLITKKYKNMGFSIKKLREMMLAE   373
PIG-025_GL0099734          I--KDN--KVNLILLSDILDM--K-SKDDFEELIRQYYRFIITKEQKLLGFSITKIREAMLED     391
```

FIG. 18Y

```
Ga0129317_1008067_chimera   I-KNN-TPDLIILSGLYPD------MAKKELVRLFYDFTVKEYKNMGFSVKKLREKMLES     325
EYZ-362B_GL0088915          N-KTN-KVNLELLAEAFPS-------EDYATLANQYDFTVFKAHKNLGFSIKKLREKLIEN    382
uncultured_Ru_sp            I-EDN-KVNISLLIDMMKG-------YEAADDIIRLYDFIVLKSQKNLGFSIKKLREKMLDE    336
R._flav._FD-1               V-TKN-ATNLYILKEVFPE-------ANFKDIADLYYDFIVIKSHKNMGFSIKKLREKMLEC    390
tpg|DBYI01000091.1|         I-ETN-NINLHILKEVFPA-------EDFQKLAALYYDFIVKKTFKNIGFSIKNLREQMLEC    390
                              *                                *  :      *.*    . *

037_--_emb|OIZA01000315.1|  GYCPLP------YDKEKEVAKLSSVKHKLYKTYDFVITHYLNSN-------------------  424
emb|OCTW011587266.1|        KNIDL-------SRLNDKFLTNNRKKLYKVIDFIYYHLNKVL------------------K    375
k87_11092736                FFPIFH------SSAPDVKRKVDTFRSKFYAILDFIIYEASVSV----ANSGQMGKVAPW     380
BMZ-11B_GL0037915           HYPD--------AKNKQFDSYRGKLYTIIDFIIYRMAAED-------------------        376
BMZ-11B_GL0037771           YASG--------LRDKKHDFHRQKINVIADFLIFRALSQN-------------------        375
BMZ-11B_GL0069617           FYSE--------IKDKQYDSYRQKIYTILDFLLFREIKDS-------------------        353
Ga0099364_10024192          FVPELT------APETKKRYDSYRAKIYGLIDFLLFKHIHNT-----------------        416
530373_GL0023589            QQELS-------PLNDKAYDSIRSKLYTMFDFVLYKLYVD------------------N      419
emb|ODAI011611274.1|        YKH---------EVRDKEYDSIRHKLYQLFSFALYHYYKTG----------------VG      436
EMG_10003641                CSEANTLLLCDEGSTVKLNVHDTMKSKFYKNLDFMIYKYYKE----------------N       434
CasR_P1E0_metageno          PDAA--------YLTGQEYDSVRQKLYMLLDFLLCRLYAQE----------------R        384
emb|OIZX01000427.1|         PDAA--------VIADKRYDTCRSKLYNLMDFLILRVYRTG----------------R        412
1605829S8_gene49834         PDAA--------KFKDDLYSSLRHKLYGLPDFILVKHFLDT------------SDSE        470
gi|1198542314|gb|NFTR01000008.1| MDEDK---KEKLKDDKYNPIRRKIYRIMDFMIYQYYQEP--------------EH            440
emb|OGNF01009141.1|         HDSNKYIK----EFDKISNKKFDSVRSRLNRLADYIIYDYNK----------------N       396
Ga0129306_1000735           HAA---------QYRDKIYDSMEKKLFSTFDFFLWRFYEE----------------R         421
MH0288_GL0082219            FAP---------EYKEKSYDSVRGKLYQLVDFLIWNIYDK----------------N         466
```

FIG. 18Z

| | | |
|---|---|---|
| PIG-022_GL0026351 | PEFC----------------NLKEDKYNSVRSKLYRLIDFIIYLNYKDAKF--------- | 382 |
| PIG-028_GL0185479 | PEFR----------------NLKDDKYNSVRSKLYRLIDFIIYLNYKDAKF--------- | 384 |
| 250twins_35838_GL0110300 | NYT----------------NLKDSKYDTYRNKIYTVLNFILFREIQEN------------ | 434 |
| PIG-014_GL0226364 | LSD----------------EGLDINDSRYDTYRNKIYTVFGFILYYELTKN--------- | 379 |
| 250twins_36050_GL0158985 | YFPE----VLDKEYDLSKNGDSVVTYRSKIYTVMNYILLYYLEDH--------------- | 437 |
| emb\|OJMM01002900.1\| | YVG-----------------NLRGKKYNTFRNKLYTVLGFILVKEIKRN----------- | 409 |
| emb\|OGPN01002610.1\| | HPWI---TTPQD----NNKANDYESCRHKLYTIMCFILVAELDAH--------------- | 449 |
| emb\|OHCP01000044.1\| | NMP----------------SLKEENTYRNKLYTVMNFILVRELKNC-------------- | 437 |
| PIG-046_GL0077813 | DMS----------------YIKSKDYDTYRNKLYTVLCFILVKELNER------------ | 442 |
| pig_chimera | DMS----------------YIKSEDYDTYRNKLYTVLCFILVKELNER------------ | 444 |
| emb\|OIEN01002196.1\| | YEL----------------NFESMQNLRPRANSFCDFLIYDYCKNE-------------- | 383 |
| 02.UC29-0_GL0096317 | YDI----------------DFECKRNLRSRANSFCDYVLYYRYAVQF------------- | 373 |
| CasR_Anaerobic_dig | PNA----------------NMLRDHQFDTVRSKFYTLLDFIIYQHYLEE----------- | 403 |
| emb\|OGDF01008514.1\| | PAL----------------SVVRSKKYDTMRSKIYSLIDFMIYRKFSEN----------- | 412 |
| emb\|OGZC01000639.1\| | PDLQ----E----------IRENHNVYDSIRSKLYKMIDFVLVYAYSNERK--------- | 438 |
| Ga0224415_10048792_chimera | KDMS----V----------IRDDHNRYDKDRSKIYTMMDFVIYRYYIDNNN--------- | 376 |
| emb\|OCVV012889144.1\| | KELS----D----------IRDNHRVFDSIRSKLYTMMDFVIYRYIEEAAKTEAENRNLPENEKK | 385 |
| Ga0187910_10006931 | EELS----D----------IRDNHKVFDSIRSKLYTMMDFVIYRYIEEAKKIENENKTLSDDKKK | 396 |
| Ga0187910_10007274 | KDMS----E----------IRKNHKVFDSIRTKVYTMMDFVIYRYYIEDAKVAAANKSLPDNEKS | 391 |
| Ga0224415_10007274 | KDMS----E----------IRENHNDFDSIRAKVYTMMDFVIYRYIEEAAKVNAANKSLPDNEKS | 374 |
| Ga0187911_10069260 | QYES---LIGV--------QIKDNKEYDTVRSKLYQLFDFALTRYFNQH----------- | 373 |
| Ga0187910_10015336 | SNS-------T--------LCADTISNNAIRPKAYKLYDFIIWHYYMNK----------- | 443 |
| ODAI_chimera | YRFR---G-----------NPVTGTDYDSVRHKLYRTFDFIICSYYDDH----------- | 443 |
| 31009_GL0034153 | DYA----------------SYIKEQGYDSVRSKLFTLIDFIIYDLYVNKE---------- | 371 |

FIG. 18AA

```
DLF014_GL0011914_            YEA---------FDIKDKRFDSVRSIMYKIIDFVIYYSFIHYK--------------------------------                    436
CasR_R._albus                TPA---------ECYKAECYNSERQKLYKLIDFLIYDLYYNRK--------------------------------                    426
Ga0187910_10040531           PEL---------SGYKEDQYNSVRSKLYKLFDFIIAHYFRKH--------------------------------                    410
tpg|DJXD01000002.1|          SDL---------KSFKEDKYNSVRAKLYKLFDFITTYYDHH--------------------------------                     355
CasR_E._siraeum              KGY---------ADKEYDSVRNKLYQMTDFILYTGYINED--------------------------------                       423
PIG-018_GL0023397            TAYT--SNPD--DRLYDKEINSVRNKLYQMTDFIIVLEYRDN--------------------------------                    411
PIG-025_GL0099734            TV----------FKTDKKYDSIRSKLYKLIDFMMFYKYTTVDSE-------------------------------                   425
Ga0129317_1008067_chimera    EEA---------SDFRDKDYDSVRRKLYKLMDFCIYYLYYS-D-------------------------------                    358
EYZ-362B_GL0088915           ------------ALRDEKIDSFRSKLYRLIDFCLFRIYLK--D-------------------------------                    411
uncultured_Ru_sp             YG----------FRFKDKQYDSVRSKMYKLMDFLLFCNYYRND-------------------------------                    419
R._flav._FD-1                DGA---------DRIKEQDMDSVRSKLYKLIDFCIFKYYHE-F-------------------------------                    423
tpg|DBYI01000091.1|          DEA---------EKIRSKDMNSVRSKLYKLFDFCIFYQYFI-D-------------------------------                    423

037_--_emb|OIZA010000315.i|  DKLLLEIVETLRLSK--------ND-DEKENVYKKYA------E--KLFKADVINPIKAISKLFAE                             474
emb|OCTW011587266.1|         DSFVDDFVAALRASQ--------SE-EEKEKLYAQYS------E--RLFADEGLKSAIKKAVDMISD                            425
k87_11092736                 KGAiDNALVKLREAP--------DE-EAKEKIYNVLA------A--SIRNDSLFL---RLKSACDKFG                           428
BMZ-11B_GL0037915            GAFLEESVQKLRSTP--------SE-EEKEKVYDVLA------E--TIWNATKDD---VKKVFDIRQQ                           424
BMZ-11B_GL0037771            QGIIDKTVSSLRLTK--------DE-EEKDHVYQNAA------E--LVWGMVSNC---LTPYFNDPKN                           423
BMZ-11B_GL0069617            --EELETMVADLRESE-------SD-EKKEELYHDYA------E--LFWDGVKDL----IVPFFAAFDG                          400
Ga0099364_10024192           --KQLEEWVAVLRETS-------NE-DAKENLYDEFA------R--TAWNTVGDS---AKQLIENMQS                           463
530373_GL0023589             EEQIDQFVRKLRAST--------SN-VEKEALYQQES------E--RTWNEIRGQ---IIDNVIPFID                           467
emb|ODAI01611274.1|          AERREAFVAKLRAVM--------TA-EAKQRAYADEA------A--EIWNDEGSG---IRAAFLEILE                           484
EMG_10003641                 PEKGEKLIEDLRSKIKGKKKED-EDKKQRYAEES------A--CILKAKRDI----IKKDLTEAAN                             487
```

FIG. 18BB

```
CasR_P1E0_metageno             ADRCEELVSALRCAL------SD-EEKDTVYQAEA----A-ALWQALGDT--LRRKLLPLLK    432
emb:OIZX01000427.1|            ADRCDKLPEALRAAL------TD-EEKAVVYHKEA----L-SLWNEMRTL--ILDGLLPQMT    460
160582958_gene49834            NLQNNDIFRQLRACR------CE-EEKDQVYRSIA----V-KVWEKVKKK--ELNMFKQVVV    518
gi|1198542314|gb|NFIR01000008.1| QEEAEELVRKLRNAE------IE-AKKELAYRKEA----E-KLKKELEKI--IFNSVLPSCD    488
emb:OGNF01009141.1             NAKVSDLVKYLRAAA------DD-EQKKKIYLNES----INLVKSGILER--IKKILPKLNG    445
Ga0129306_1000735              EDEAEELRACLRAAR------SD-EEKEQIYAEAA----A-SCWPSVKPF--VESVAATLCD    469
MH0288_GL0082219               EKMADALVAQLRAEVK-----RDR-DEKSPVYDREA---A-RLWTMIREA--VAQTAKTLRA    516
PIG-022_GL0026351              DEKIERFVSKLRKCP------DE-ASKETVYQTES----D-IIKKSIYGS--INSIKRGMM-    429
PIG-028_GL0185479              DEKIERFVSKLRKCP------DE-ASKETVYQTEA----D-IIKKSISGS--INSIKRDMM-    431
250twins_35838_GL0110300       SIAIKNFREKLRSTE------K--AEQPALYQAFA----N-KIYPMVQAK--FAKAIDLFEE    481
PIG-014_GL0226364              ETFCQEIVAKLRRFG------GDEIEKNKIYNEYFLRKE-AVYNQIAEK--FKQSVCWFKK    431
250twins_36050_GL0158985       DSSRESMVEALRQNR------EGDEGKEEIYRQFA----K-KVWNGVSGL--FGVCLNLFKT    486
emb:OJMM01002900.1|            PKIQDSFIAKLRANQ------NGDEGKLNIYNEFA----P-KIWSVVSSK--LNSAITCFDE    458
emb:OGPN01002610.1|            ESIRDNMVAELRANM------DGDDGRDAIYEKYA----K-DIYHIVKDK--LLAMQKVFDE    498
emb:OHCP01000044.1|            ATIREQMIKELRANM------DEEEGRDRIYSKYA----K-EIYLYVKDK--LKLMLNVFKE    486
PIG-046_GL0077813              TTIREQMVADLRANM------NGDIGREDIYSKYA----K-IIYAQVKPR--FDGMKNVFEE    491
pig_chimera                    TTIREQMVADLRANM------NGDIGREDIYSKYA----K-IIYAQVKPR--FDIMKSAFEE    493
emb:OIEN01002196.1|            -SERANLVDCLRSAA------SE-EEKKNIYFQTA----E-RVKEKFRNA--FNRISRFDAS    430
O2.UC29-0_GL0096317            PERIVDLVDKLRCSA------NE-KEKTNVYIEEA----N-RIKEDLRIA--FNRINNFDAK    421
CasR_Anaerobic_dig             KSRIDNMVEKLRMTL------KE-EEKEVLYAAEA----K-IVWNAIGAK--VINKLVPMMN    451
emb:OGDF01008514.1|            HVAVDDFVEELRSLL------TE-DEKESAYSRWA----ETLINDGFAQE--ILVKLLPQTD    461
emb:OGZC01000639.1             SKADALASNLRSAI------TE-DAKKRIYQNEA----D-QLWTSYQEL--FKRIRGFKGA    485
Ga0224415_10048792_chimera     ---DSIDFINKLRSSI-----DE-KSKEKLYNEEA----N-RLWNKLKEY--MLYIKEFNGK    422
emb:OCVV01288914.1|            ISEKDFFVINLRGSF------DE-NQKEKLYIEEA----K-RLWEKLKDI--MLKIKEFRGE    433
```

FIG. 18CC

| | | |
|---|---|---|
| Ga0187910_10006931 | LSEKDIFIISLRGSF------SE-EQKDKLYSDEA------E-RLWAKLGKL---MLEIKKFRGQ | 444 |
| R._flav_XPD__ | LSEKDIFVINLRGSF------ND-DQKDALYYDEA------N-RIWRKLENI---MHNIKEFRGN | 439 |
| Ga0224415_10007274 | LSEKDIFVISLRGSF------NE-DQKDRLYYDEA------Q-RLWSKVGKL---MLKIKKFRGK | 422 |
| Ga0187911_10069260 | PDMVDAFVVELRSLA------KDEDAKNAVYEKYA------K-AVWNDVKQP---IAVMLSYMNG | 422 |
| Ga0187910_10015336 | PDKINDFVEKLRTQN------KN-DEKIKLYYDEA------V-CLLSELGRE---IHTMTSCVHN | 491 |
| ODAI_chimera | AKEKDTLVSSLRASL------ND-TKKENLYAGEA------K-TIAESIKDR---MDTVCRMYNK | 491 |
| 31009_GL0034153 | KDRIDDIVSKLRGAI------YD-YKKDDIYKAEA------D-WVWKKLNRQ---IKALTKLLSN | 419 |
| DLF014_GL0011914_ | QDEVDEIVNYLRSTL------SE-EQKKEKYIKLA------G-NIWAEYKTQ---FNKLKDILLA | 484 |
| CasR_R._albus | PARIEEIVDKLRESV------ND-EEKESIYSVEA------K-YVIESLSKV---LDKSLKNSVS | 474 |
| Ga0187910_10040531 | PEKGEEMVDCLRLCM------TE-DEKDSHYEGTA------K-KLVRELAYD---MQEAAEQANG | 458 |
| tpg|DJXD01000002.1| | AFEKEALVSSLRSSL------TE-ENKEEIYIKTA------R-TLASALGAD---FKKAAADVNA | 403 |
| CasR_E._siraeum | SDRADDLVNTLRSSL------KE-DDKTTVYCKEA------D-YLWKKYRES---IREVADALDG | 471 |
| PIG-018_GL0023397 | KSIIDTLVSKLRSSV------TD-EAKEAVYREEA------A-NLRGRLLDA---VALIAKSLNG | 459 |
| PIG-025_GL0099734 | KEHADSIVEKLRATL------SG-ESKEEIYKAEA------N-RIWNLYEDI---IMNKIEPALD | 473 |
| Ga0129317_1008067_chimera | SERNENLVSRLRESL------TD-ENKDIIYSKEA------K-IVWNELRKK---FSTILDNVKG | 406 |
| EYZ-362B_GL0088915 | PDRAEKNVRFLRSCI------NE-QEKEQFYTQEA------N-ALKSENPGL---VNDFCMQLKD | 459 |
| uncultured_Ru_sp | IAAGESLVRKLRFSM------TD-DEKEGIYADEA------A-KLWGKFRND---FEMIADHMNG | 467 |
| R._flav_FD-1 | PELSEKNVDILRAAV------SD-TKKDNLYSDEA------A-RLWSIFKEK---FLGFCDKIVV | 471 |
| tpg|DBYI01000091.1| | EERSRENVNYLRSTL------ND-EQKDAFYEEEG------K-RLWSENRKK---FIYFCDNINK | 471 |
| | **                    :               *     | |
| 037_--_embl|OIZA01000315.1| | KGNKLFKEK-----------------------iIIKKEYIEDVSIDKNIYDFTKVIFFMTCF | 513 |
| embl|CCTW01158726.1| | TKSNIFKMK------------------------TPLDKALIENIKVNSDASDFCKLIYFTRF | 464 |
| k87_11092736 | AEQNRPVFPNELR-------------------NNRDIRNVRSEWLEATQDVDAAAFVQLIAFLCNF | 475 |

FIG. 18DD

| | | |
|---|---|---|
| BMZ-11B_GL0037915 | DIKNAAAQS----------------------------LDDVNLDSVTVEKEKEFPVVKLLAFLCNF | 462 |
| BMZ-11B_GL0037771 | KYILKYKDA----------------------------KTPGDFEDWITSKISEDDGEPFVKVLSFLCNF | 464 |
| BMZ-11B_GL0069617 | DFTVFTTEK----------------------------VPADTSKEPFLSSANTEPLVKLLAFLCNF | 438 |
| Ga0099364_10024192 | YFTKKEKEIT--K-------------------------TAQPVLSTSSIAHTSKKITQFSSFAKLLAFLCNF | 508 |
| 530373_GL0023589 | SIQKQENEDKLTKR------------------------IDQSIIDKAVPHFVNSRDLSYFAKVVYVVASF | 513 |
| emb\|ODAI01161274.1\| | AVDFGSAVKGIKARSS----------------------VAGDKRFAEWLEEVRIRPEGVSCFTKLMYLLTRF | 534 |
| EMG_10003641 | KDLFADLVKSNKNEKQK---------------------FKNEYEELLKPFMIPVKVDYFSELIYLVTRF | 535 |
| CasR_P1E0_metageno | GKKLQDKDK-KKSDELGLSRDVLDGVLFR---------PAQQGSRANADYFCRLMHLSTWF | 483 |
| emb\|OIZX01000427.1\| | PENLSRLSGQKRKGELSLDDAMLKECLYE---------PGPVPEDAAPEEANAEYFCRMIYLATLF | 517 |
| 160582958_gene49834 | IPSLSKDE----------------------------LKQMEMTKNTELLSSIETISTQASLFSEMIFMMTYL | 562 |
| gi\|1198542314\|gb\|NFIR01000008.1\| | RILSEMDERRNKKVNQESSDTDKEEPL-----------DSEIAEGITFIKETAHSFSEMIYLLTVF | 543 |
| emb\|OGNF01009141.1\| | KIIGNMQPDSTI-------------------------TASMLHNTGKDWHPISENAHYFTKMIYTLLLF | 489 |
| Ga0129306_1000735 | VVKGR--------------------TKLNKIKLSADESTLVRNAIDGVRISPRASYFTKLIYLMTLF | 516 |
| MH0288_GL0082219 | VTLSNNTPGSIKIKELALSKYDRDLVENAIDSAVDERGRRLKITDEASYFSKLIYLLTLF | 576 |
| PIG-022_GL0026351 | ---------------------SVKSKYGKLELDKQTINQLKRAVDDISINTKGDYFTKLMYLISLL | 474 |
| PIG-028_GL0185479 | ---------------------LVKSKYGKLELDTQTVNQLKRAVDDISINTKGDYFTKLMYLISLL | 476 |
| 250twins_35838_GL0110300 | QYKTKFKSEFKGGI-----------------------SIENMQQNILLQTENIDYFSKYVLFLTKF | 525 |
| PIG-014_GL0226364 | EKEKKKEFSS---------------------------KTKIDLRSVQKIEDQNASVFAKMVYLISRF | 471 |
| 250twins_36050_GL0158985 | EKRNKFRSKV---------------------------ALPDVSGAAYMLSSENIDYFVKMLFFVCKF | 526 |
| emb\|OJMM01002900.1\| | ESLSKFKGYK----------------------------DIDESLISRYGITVANTDTLVKILYFLCKF | 498 |
| emb\|OGPN01002610.1\| | ELVPVKVEGKNDPQ--Q------------------------FTHGKLGKKEIESFCLSDKNTSDIAKVVYFLCNF | 547 |
| emb\|OHCP01000044.1\| | EAEGIIPGKEDPV--K------------------------FSHGKLDKKEIESFCLTTKNTEDITKVIYFLCKF | 535 |
| PIG-046_GL0077813 | EAKGVIVPDKEEAV--K------------------------FSNGALDKSEIERFCITSANTDSVAKIIYFLCKF | 540 |
| pig_chimera | EAKDVIVPDKKKPV--K------------------------FSHGKLDKNEIERFCITSANTDSVAKIIYFLCKF | 542 |

FIG. 18EE

| | | |
|---|---|---|
| emb\|OIEN01002196.1\| | YIKNSREKNLSGGS--SLPK------YSFIEGFTKRSKKINDNDEKNADLFCNMLYYLAQF | 483 |
| O2.UC29-0_GL0096317 | SIKLYSIKNNVDDQ---PMLP-------FEQVSK------DIKGGDAAREKADAFCDMTYYLTQF | 470 |
| CasR_Anaerobic_dig | GDALKEIKRKN---------------------------RDRKLPQSVIATVQVNSDANYFSGLIYFLTLF | 494 |
| emb\|OGDF01008514.1\| | PAVIGKIG----------------------------KKLLNDSIAGIKLKKDASFFTKIINVLCMF | 500 |
| emb\|OGZC01000639.1 | QVKEYSSKN--M------------------P-----IPIQKQIQNILKPAEQVTIFTKLMYLLTMF | 526 |
| Ga0224415_10048792_chimera | LASRTPDRD--G-----------------NISEFVESLPKIHRLLPRGQKISNFSKLMYLLTMF | 467 |
| emb\|OCVV012889144.1\| | KVKEYK--------------------KEVPRIERILPQGKDISAFSKLMYMLSMF | 468 |
| Ga0187910_10006931 | MTRDYK-------------------KSDTPTLNRILPESEDVSTFSKLMYALTMF | 480 |
| R._flav_XPD_ | KTREYK-----------------------KKDAPRLPRILPAGRDVSAFSKLMYALTMF | 475 |
| Ga0224415_10007274 | DTRKYK------------------NMGTPRIRRLIPEGRDISTFSKLMYALTMF | 458 |
| Ga0187911_10069260 | SAIKNIKAFEL------------KPDQKELNGIMNSNALDVPHFCKLVYFLTRF | 464 |
| Ga0187910_10015336 | IENTSYEITDK----------KQKEYYKMQINSLNSADKVSDFSKVIYLVTLF | 534 |
| ODAI_chimera | GEGIKHITVDR---------FIAGAGAGKLIDKCSISTECDYFCKFIYLMTLF | 535 |
| 31009_GL0034153 | RRIFSQDND--------ITNWNGVEFEKIGEQKLEDNADYFCKLMYFVTLF | 462 |
| DLF014_GL0011914_ | NIKEFSDAKEDDV----YYEEFKNFKFNEVGKEKLGENAEYFCKLMYLLTLF | 532 |
| CasR_R._albus | GETIKDLQKRY-------DDETANRIWDISQHSISGNVNCFCKLIYIMTLM | 518 |
| Ga0187910_10040531 | SNITQMQKNEQQG-----KT-KGMFAIRDEIRVSRKPVSYFSKVIYVMTLL | 503 |
| tpg\|DJXD01000002.1\| | KNIRDYQKKAN------------DYRISFEDIKIGNTGIGYFSELIYMLTLL | 443 |
| CasR_E._siraeum | DNIKKLSKS------------NIEIQEDKLRKCFISYADSVSEFTKLIYLLTRF | 513 |
| PIG-018_GL0023397 | VNIKKLQQN-------------TLEIPDSKLENCFIKSAEKVSAFTKLNYLLTRF | 501 |
| PIG-025_GL0099734 | EGVISGLKK-------------NKSYDNMSIEGIVAEETANVSYFSKIIYLLAQF | 515 |
| Ga0129317_1008067_chimera | SNIKKLEN-----------------VKEKFISEDEFDDIKLDIDSTFSKLMYVMCYF | 447 |
| EYZ-362B_GL0088915 | RYSSGSNSTENAE-----------KKEDFPVFPHCHDKQKVSNVSLFAKLMYAFCLF | 505 |
| uncultured_Ru_sp | DVIKELGK-----------------ADMDFDEKILDSEKKNASDLLYFSKMIYMLTYF | 508 |

FIG. 18FF

| Identifier | Sequence | Number |
|---|---|---|
| R._flav._FD-1 | WVTGEHEK----------------------------------DITSVIDKDAYRNRSNVSYFSKLMYAMCFF | 509 |
| tpg\|DBYI01000091.1\| | WVKNDYSD---------------------------------EVAKCIDLNEFRVNSNVSYFSKLLYAMSFF | 509 |
| 037--emb\|OIZA01000315.1\| | LDGKEINDLLTNIISKLQVIEDHNNVIKFIFH-------------------------------------NKD | 548 |
| emb\|OCTW011587266.1\| | LDGKEINILLNSLIKKFQDIHSFNTIVKKLSE-------------------------------------NNL | 499 |
| k87_11092736 | LEGKEINELVTALIKKFEGIQALIDLLRNLEGV---------------------------------------- | 508 |
| BMZ--11B_GL0037915 | LDGKEINELLSTFVNRLENVQALIDLAKNLGET---------------------------------------- | 495 |
| BMZ--11B_GL0037771 | LEGKEINELLTAYIHKFECIQDFLNVISSLGEN---------------------------------------- | 497 |
| BMZ--11B_GL0069617 | WDGKEVNEVLSAYIHKFESIQAFIDVLESKELN-------------------------------------EKV | 474 |
| Ga0099364_10024192 | WEGKEINELLSAYIHKFENIQEFINLLEKLEGK---------------------------------------- | 541 |
| 530373_GL0023589 | LDSKEINMFFDALINELENIASFNDVLEQLDM---------------------------------------- | 545 |
| emb\|ODAI011611274.1\| | LDGKEINELLTGLINKLENIQSFLDVMQQEHA---------------------------------------- | 566 |
| EMG_10003641 | LSGKEINDLLTQLINKFENIAAFIRMYQNDQG---------------------------------------- | 567 |
| CasR_P1E0_metageno | MDGKEINTLLTTLISKLENIDSLRSVLESMGL---------------------------------------- | 515 |
| emb\|OIZX01000427.1\| | MDGKEINTLLTTLISKFENIAAFLQTMEQLNI---------------------------------------- | 549 |
| 160582958_gene49834 | LDGKEINLLCTSLIEKFENIASFNEVLKSPQIG--------------------------------------- | 595 |
| gi\|1198542314\|gb\|NFIR01000008.1\|: | LDGKEINILLTQLIHCFDNISSFMDTMEEENL---------------------------------------- | 575 |
| emb\|OGNF01009141.1 | MDGKEINDLVTTLINKFDNIASFIEVLKSQSV---------------------------------------- | 521 |
| Ga0129306_10000735 | LDGKEINDLLTTLIHAFENIDSFLSVLGSERL---------------------------------------- | 548 |
| MH0288_GL0082219 | LDGKEINDLITTLVNSFDEIDSFCCVLQKAKL---------------------------------------- | 608 |
| PIG-022_GL0026351 | IDGKEINDLLTTLIHQFENIASFIDVMKKENI---------------------------------------- | 506 |
| PIG-028_GL0185479 | IDGKEINDLLTTLIHQFENIASFIDVMKKENI---------------------------------------- | 508 |
| 250twins_35838_GL0110300 | LDGKEINELLCALINKFDNIADLLDISKQIGT---------------------------------------- | 557 |

FIG. 18GG

| | | |
|---|---|---|
| PIG-014_GL0226364 | LDGKEINELCTKLLNKFKNINELVETAKRCGE | 503 |
| 250twins_36050_GL0158985 | LDGKEINELLCALINKFDNIADILDAAAQCGS | 558 |
| emb\|OJMM01002900.1\| | LDGKEINELCCAMINKFDNINDLIKTAAQCGE | 530 |
| emb\|OGPN01002610.1\| | LDGKEINELCCAMMNKFDGIGDLIDTAKQCGE | 579 |
| emb\|OHCP01000044.1\| | LDGKEINELCCAMMNKLDGISDLIETAKQCGE | 567 |
| PIG-046_GL0077813 | LDGKEINEFCCAMMNKLDGINDLMETAEQCGA | 572 |
| pig_chimera | LDGKEINELCCAMMNKLDGINDLIETAEQCGA | 574 |
| emb\|OIEN01002196.1\| | LDGKEINIFLTSIHNIFQMIDSFLKVMKEKGM | 515 |
| O2.UC29-0_GL0096317 | LDGKEINVFLTTLHNLFENIASFLDVMHKQNI | 502 |
| CasR_Anaerobic_dig | LDGKEINEMVSNLITKFENIDSLLHVDREIYKSDEKDLDLEIEKLALFFKGVVRPNAKTD | 554 |
| emb\|OGDF01008514.1\| | QDGKEINELVSSLVNKFANIQSFVDVMRSQGI | 532 |
| emb\|OGZC01000639.1\| | LDGKEINDLLTTLINKFDNISSLLKTMEQLEL | 558 |
| Ga0224415_10048792_chimera | LDGKEINDLLTTLINKFENIQGFLDIMPEINV | 499 |
| emb\|OCVV01288914.1\| | LDGKEINDLFTTLINKFDNIQCFLKIMPLIGV | 500 |
| Ga0187910_10006931 | LDGKEINELLTTLINKFDNIQSMLKIMPLIGV | 512 |
| R._flav_XPD_ | LDGKEINDLLTTLINKFDNIQSFLKVMPLIGV | 507 |
| Ga0224415_10007274 | LDGKEINDLLTTLINKFDNIQSFLKVMPLIGV | 490 |
| Ga0187911_10069260 | LDGKEINDLLTTLVNKFDNIHSPNQVLTALGL | 496 |
| Ga0187910_10015336 | LDGKEINDLLTTLINKFDNIASLLSVLEKQSG | 566 |
| ODAI_chimera | IDGKEINDLLTTLINKFDNIDSPSVDKAVNNQ | 567 |
| 31009_GL0034153 | LDGKEINDLLTTLINKFDNIRSFIEVMEEMSL | 494 |
| DLF014_GL0011914_ | LDGKEINDLLTTLINKFDNIRSFVELMKEENI | 564 |
| CasR_R._albus | LDGKEINDLLTTLVNKFDNIASFIDVMDELGL | 550 |
| Ga0187910_10040531 | LDGKEINDLLTTLINKFENIVSFEDVLRQLNV | 535 |

FIG. 18HH

| | | |
|---|---|---|
| tpg\|DJXD01000002.1\| | LDGKEINDLLTTLINKFDNIISFIDILKKLNL------------------------------ | 475 |
| CasR_E._siraeum | LSGKEINDLVTTLINKFDNIRSFLEIMDELGL------------------------------ | 545 |
| PIG-018_GL00023397 | INGKEINDLLTTLINKFDNIRSFLETMDELGL------------------------------ | 533 |
| PIG-025_GL00099734 | IDGKEVNDLLTTLINKFDNIRSFIDTANQIGL------------------------------ | 547 |
| Ga0129317_1008067_chimera | LDGKEINDLLTTLVSKFDNIGSIIEAATQIGI------------------------------ | 479 |
| EYZ-362B_GL00088915 | LDGKEINELLSALLNKFDTIACMTKCTKDLGI------------------------------ | 537 |
| uncultured_Ru_sp | LDGKEINDLLTTLISKFDNIKEFLKIMKSSAVD------------------------------ | 541 |
| R._flav._FD-1 | LDGKEINDLLTTLINKFDNIANQIKTAKELGI------------------------------ | 541 |
| tpg\|DBYI01000091.1\| | LDGKEINDLLTTLINKFDNIRSFIDTANFLNI------------------------------ | 541 |
| | .   *   *: *                                                  | |
| 037_--_emb\|OIZA01000315.1\| | AVYKDYSDKYAIFR-------------------NA---------GKIATELEAIKSI | 577 |
| emb\|OCTW01158726.1\| | IINADYVDDYSLFE-------------------QS---------GTVARELMLIKSI | 528 |
| k87_11092736 | -DSIRFENEFALFN-------------------DD---------KGNMAGRIARQLRLLASV | 541 |
| BMZ-11B_GL00037915 | ---VNFSKNYAVFN-------------------DC---------GSGAAGRIAERLRLLASI | 526 |
| BMZ-11B_GL00037771 | ------VQFQPRFALFN-------------------NA---------SFAQNVAVQLRILASI | 526 |
| BMZ-11B_GL00069617 | VFSAKKGRNFSAFN-------------------EH---------GFAGRVADQLRVLASI | 506 |
| Ga0099364_10024192 | ----KPQFTENYALFN-------------------EA---------AGQRAGEIAQNLRILASI | 573 |
| 530373_GL00023589 | ---PLDYQEKYRFFE-------------------RS---------REEAAGLRFIKSI | 572 |
| emb\|ODAI01161127.1\| | ----ETGLSDAFSPFE-------------------YS---------GEIAAELRMTRSF | 593 |
| EMG_10003641 | ---KLEFTANYKMFEIDPQKDIPKDGKRVLSGS---------AKIAYYLRTINYI | 610 |
| CasR_P1E0_metageno | ---AYSFVPAYAMFD-------------------HS---------RYIAGQLRVVNNI | 542 |
| emb\|OIZX01000427.1\| | ----EAELGPEYAMFT-------------------RS---------RAVAEQLRVINSF | 576 |
| 160582958_gene49834 | -YETKYTEGYAFFK-------------------NA---------DKTAKELRQVNNM | 623 |

FIG. 18II

| ID | Sequence | # |
|---|---|---|
| gi\|1198542314\|gb\|NFIR01000008.1\| | --LTKLKEDYEIFE--------------ES-------------KEISRELRIINSF | 602 |
| emb\|OGNF01009141.1\| | ---CTHFSEERKMFI--------------DS-------------AEICSELSAMNSF | 548 |
| Ga0129306_1000735 | ---ERTFDANYRIFA--------------DS-------------GVIAQELRAVNSF | 575 |
| MH0288_GL0082219 | ----DRGFTEGYRFFA--------------HS-------------AEISQELRAINSF | 635 |
| PIG-022_GL0026351 | ---NYEFAEKYKFFN--------------TS-------------KNIACELRTVNSF | 533 |
| PIG-028_GL0185479 | ---ECEFTEKFAFFK--------------NS-------------EIAHELRTVNSF | 535 |
| 250twins_35838_GL0110300 | ---PVVFCADYESLN--------------DA-------------AKIAENIRLIKNI | 584 |
| PIG-014_GL0226364 | ---TIEFCPEYKMFK--------------NS-------------AKLAEEMRFVQSV | 530 |
| 250twins_36050_GL0158985 | ---SVWFVDSYRFFE--------------RS-------------RRISAQIRIVKNI | 585 |
| emb\|OJMM01002900.1\| | ---DIEFVKEYKLFI--------------NS-------------NDLSDQIRIVKSI | 557 |
| emb\|OGPN01002610.1\| | ---EVKFIEEFACLS--------------NC-------------RKITNDIRVAKSI | 606 |
| emb\|OHCP01000044.1\| | ---DVEFVDQFKCLS--------------KC-------------ATMSNQIRIVKNI | 594 |
| PIG-046_GL0077813 | ---KIEFVDNFNVLS--------------KC-------------GTISGQIRVVKSI | 599 |
| pig_chimera | ---KVEFVDKFSVLS--------------NC-------------ETISDQIRIVKSI | 601 |
| emb\|OIEN01002196.1\| | ---ECKFQKDFKMFS--------------HA-------------GHVAKKIEIVISL | 542 |
| O2.UC29-0_GL0096317 | ---SYDFTEQYVMFY--------------DS-------------AYIVKKLETVISV | 529 |
| CasR_Anaerobic_dig | TGAGEISKSFSIFQ--------------SA-------------ERIEELKFIKNV | 583 |
| emb\|OGDF01008514.1\| | ---DSGFTADYAMFA--------------ES-------------GRISRELHILKGI | 559 |
| emb\|OGZC01000639.1 | ---QTTFKEDYTFFQ--------------QS-------------SRLCKETTQLKSF | 585 |
| Ga0224415_10048792_chimera | ---NAKFEPEYVFFN--------------KS-------------HEIAGELKLIKGF | 526 |
| emb\|OCVV01288914.1\| | ---NVKFTEDYAFFN--------------KS-------------EKIADELRLIKSF | 527 |
| Ga0187910_10006931 | ---NAKFSSDYAFFN--------------NS-------------EKIADELKLIKSF | 539 |
| R._flav_XPD_ | ---NAKFVEEYAFFK--------------DS-------------AKIADELRLIKSF | 534 |
| Ga0224415_10007274 | ---NAKFAEEYSFFN--------------NS-------------EKIADELRLIKSF | 517 |

FIG. 18J

| | | | |
|---|---|---|---|
| Ga0187911_10069260 | ---SASYEADYKIFE | ----------DS-------- | ------GRVVEYLREINSF | 523 |
| Ga0187910_10015336 | -KKVEFVENYSFFN | -SSNLLKERTLNKSENYTCKIVEELREINSF | | 609 |
| ODAI_chimera | -NRVEFGDKYDMFN | ----------KA-------- | ------GEICESLKSINSF | 595 |
| 31009_GL0034153 | ---KCEFMEEYKFFN | ----------ES-------- | ------KDICLRLKEIHSF | 521 |
| DLF014_GL0011914 | ---ECIFDKKFAFFD | ----------ES-------- | ------KNVCSTLREINSF | 591 |
| CasR_R._albus | ---EHSFTDNYKMFA | ----------DS-------- | ------KAICLDLQFINSF | 577 |
| Ga0187910_10040531 | -DCTFKPEFAFFG | ----------Y-D------- | ------RCRNISGELRLINSF | 564 |
| tpg\|DJXD01000002.1\| | -EFKFKPEYADFT | ----------NMT------- | ------NCRYTLEELRVINSI | 505 |
| CasR_E._siraeum | --DRTFTAEYSFFE | ----------GS-------- | ------TKYLAELVELNSF | 572 |
| PIG-018_GL0023397 | --ERTFTENYRFFE | ----------DS-------- | ------QKYRDELIELNSF | 560 |
| PIG-025_GL0099734 | -ECNLLDEYQFFN | ----------TS-------- | ------DTVKKELHVIKNL | 574 |
| Ga0129317_1008067_chimera | -NIEFIDDFKFFD | ----------RS-------- | ------KDISVELNIIRNF | 506 |
| EYZ-362B_GL0088915 | ---YAPFSKDFNFFE | ----------DS-------- | ------EQRAEEMNLVKSI | 564 |
| uncultured_Ru_sp | -VECELTAGYKLFN | ----------DS-------- | ------QRITNELFIVKNI | 569 |
| R._flav._FD-1 | --NTAFVKNYDFFN | ----------HS-------- | ------EKYVDELNIVKNI | 568 |
| tpg\|DBYI01000091.1\| | ---DVKFTKDYDFFN | ----------II-------- | ------CDYAGELNIIKNI | 568 |
| | : | | . | |
| 037_--_emb\|OIZA01000315.1\| | ARMENKIE-- | -NAPKEPLLKDALLALGVSSNDFDEKYEKYFKTDVD----- | | 620 |
| emb\|OCTW01158726.1\| | SKMDFGLD-- | -NINLSFMYDDALRTLGVSDENLPEVKREYF--------- | | 566 |
| k87_11092736 | GKMKPDMT-- | -DAKRVLYKSALEILGAPPD-----------EVS------ | | 571 |
| BMZ-11B_GL0037915 | GKMDAGLD-- | -SLKPLFIRFAIQILGGARIS----------DEDV----- | | 558 |
| BMZ-11B_GL0037771 | GKMKPDLT-- | -EAKRPLYKAAIRMLCPPEK-----------WEKYTS--- | | 559 |
| BMZ-11B_GL0069617 | GKMKPDLE-- | -GAKRALFRDAVETLGIVENSNWLNEDGTIS--------- | | 544 |

FIG. 18KK

| Name | Sequence | Position |
|---|---|---|
| Ga0099364_10024192 | GKMKPDLG----------------DAKRQLYKAAIEMLGIDTE------------EYIS--- | 604 |
| 530373_GL0023589 | AKMNKTRVA---------VRNDIKTKTVKLKQYCDAGAVLGEINAEKIKAAFGLGD------ | 617 |
| emb:ODAI01161274.1 | ARMAAADP----------EAKRFMVDGAKLLGFNPKDTESEDEGIIRAIYGDAC | 638 |
| EMG_10003641 | ARMESFEI----------KSDKTAINDAISLLGYNSNEHRDEFITYTMAKHVVDK | 655 |
| CasR_PIE0_metageno | ARMRKPAI----------GAKREMYRAAVVLLGVDSPEAAAAITDDLLQI------ | 582 |
| emb:OIZX01000427.1 | ALMKKPQV----------NAKQQLYRAAVTLLGTEDPDGVTDEMLCIDF------ | 615 |
| 160582958_gene49834 | ARMTKPLG---------GVNTKCVMYNEAAKILGAKPMSKAELESVFNLDNHD--- | 667 |
| gi|1111985423|gb|NFIR01000008.1| | ARMTEPVP----------KTERIMFIEAAQILGYSNGEKELEGYVDALLD-------- | 642 |
| emb:OGNF01009141.1 | ARMEAPGA----------SSKRAMFVEAARILGDNRSKEELEEYFDTL-------- | 586 |
| Ga0129306_1000735 | ARMTEPF------------NSKLVMFEDAAQLFGMSGGLVEHAEELREYLDNK--- | 617 |
| MH0288_GL0082219 | ARMTETV----------QGKPCMFEDAADLLGMDTDLEEVREALEAFYNKE---- | 677 |
| PIG-022_GL0026351 | ARMTGFMEN-----------------DESTKFIMFREAADILGTSYTDDELTDHLNL------ | 573 |
| PIG-028_GL0185479 | ARMTGFMEN-----------------DESTKFIMFREAADILGTSYTDDELTDHLNL------ | 575 |
| 250twins_35838_GL0110300 | AHLRPAIQ------EAQSSKDNADAAGTPATLLIDAYNMLNTDIQL---------- | 624 |
| PIG-014_GL0226364 | SKMKKLIK----KE-------DKSIKPQVIDDALELLGLKIEKYKKDDQGNFVLDDQ---- | 576 |
| 250twins_36050_GL0158985 | ASKDFKKS----KKD-------SDESYPEQLYLDALALLGDVISKYQNRDGSVVIDDQ---- | 633 |
| emb:OJMM01002900.1 | SKMKPELS----KI--------GEALILDAIDILGYKINKYKYDAAGNRLVDSN---- | 599 |
| emb:OGPN01002610.1 | SKMKNKVN----ID---------NDIIYLDAIELLGRKIEKYQKDENGKILLGTD--- | 648 |
| emb:OHCF01000044.1 | SRMKKEMT----ID---------NDTIFLDALELLGRKIEKYQKDKNGDYVKDEK--- | 636 |
| PIG-046_GL0077813 | SKMKKEID----VD----------NETIFLDAFELLGKRIEKYKKDDSGNVLRNDD-- | 641 |
| pig_chimera | SKMKKEIA----ID----------NDTIFLDALELLGRKIDKYKKDATGKYLKDEN-- | 643 |
| emb:OIEN01002196.1 | AKMKKTL-------------DFYNAQALKDAVTILGVSKKHQYLDMNSYLDFYMF---- | 584 |
| O2.UC29-0_GL0096317 | SRMKKAL-------------DFYNGQALRDAIRVLGISERHVDMDMKEYVDKYLF---- | 571 |
| CasR_Anaerobic_dig | TRMDNEI-------------FPSEGVFLDAANVLGVRGDDFDFSNEFVGDDLHSD--- | 625 |

FIG. 18LL

| | | |
|---|---|---|
| emb\|OGDF01008514.1\| | ARMQHSIAGLGDVKIYGSDDKFHGVSRRVYTDAAYILGFGERSEDNDGY---VDD------ | 611 |
| emb\|OGZC01000639.1\| | ARMGNPI-------------------SNLKEVMMVDAIQILGTEKSEQELQSM--ACP------ | 622 |
| Ga0224415_10048792_chimera | AQMGEPA-------------------ATLKLEMTADAIKILGTEKEDAELIKL--AES------ | 563 |
| emb\|OCVV012889144.1\| | ARMGEPV-------------------ANTKRVMMIDAVKILGTDLSDDELVNM--ADS------ | 564 |
| Ga0187910_10006931 | ARMGEPV-------------------ANAKRDMMIDAIKILGTDLDDNEIKKL--ADS------ | 576 |
| R._flav._XPD_ | ARMGEPI-------------------ADARRAMYIDAIRILGTNLSYDELKAL--ADT------ | 571 |
| Ga0224415_10077274 | ARMGEPV-------------------ADARRAMYIDAIRILGTDLSDDELKAL--ADS------ | 554 |
| Ga0187911_10069260 | ARMTVDM-------------------EKIKRSAYKKALLILGSSKYSDEDLDARVDEMLGV--- | 565 |
| Ga0187910_10015336 | ARMTGDC-------------------KIRKSAFEDASQLLGYHDKTVNNLFEVLRLKELESK-- | 652 |
| ODAI_chimera | ARMESPA-------------------PAAKRTMFVDAIRMFGFADVSDNDAEKFYKENIEP--F- | 638 |
| 31009_GL0034153 | ARMKRPLD------------------NKNVEKEMYKDAISILMKDSSIENSNIDVIFNTYIY--- | 565 |
| DLF014_GL0011914_ | ARMQKPLN------------------NVSVKREMYKDAIKILLKDTRAEEQNIDRILNEYIP--- | 635 |
| CasR_R._albus | ARMSKID-------------------DEKSKRQLFRDALVILDIGNKDETWINNYLDSDIFK--- | 620 |
| Ga0187910_10040531 | ARMQKPS-------------------AKAKHVMYRDALRILGLDNGMSEEALDQEVRRILQ---- | 606 |
| tpg\|DJXD01000002.1\| | ARMQKPS-------------------ADARKIMYRDALRILGMDNRPDEIDRELERTM------ | 545 |
| CasR_E._siraeum | VKSCSFD-------------------INAKRTMYRDALDILGIESDKTEEDIERMIDNILQ---- | 614 |
| PIG-018_GL0023397 | AKSCSFD-------------------ISAKRIMYRDALDILGIQAELSEDEIGRMIDNILQ---- | 602 |
| PIG-025_GL0099734 | TGMGYYD-------------------VSIKHQMYKDAIDILGLHDNLSDEEINQLIDTNIL--F- | 617 |
| Ga0129317_1008067_chimera | ARMQAPV-------------------PNAKRAMQEDAIRILGGSEEDIFSILDDMTG------- | 544 |
| EYZ-362B_GL0088915 | ARMTKPD-------------------IQAKEQLFRDALDILGVEVGVSEEALQKEIH------- | 602 |
| uncultured_Ru_sp | ASMRKPA-------------------ASAKLTMFRDALTILGIDDKITDDRISGILK------- | 607 |
| R._flav._FD-1 | ARMKKPS-------------------SNAKKAMYRDALTILGIPEDMDEKALDEELDLILE---- | 610 |
| tpg\|DBYI01000091.1\| | ARMKKPS-------------------PSAKKNMYRDALTLLGIPTEMSDEQLDAEIDKILE---- | 610 |

FIG. 18MM

| | | |
|---|---|---|
| 037_-_emb\|OIZA01000315.1\| | ------------------------------------------------------ | 620 |
| emb\|OCTW01158726.1\| | --------------------------DEWLAENILLDKSNNDYQKAK-------- | 566 |
| k87_11092736 | --------------------------DAYIKENILVRKDDPEKK----------- | 592 |
| BMZ-11B_GL00037915 | ------------------------------------------------------ | 576 |
| BMZ-11B_GL00037771 | --------------------------DEWLEKNMLLNSEDRKNDKKK-------- | 580 |
| BMZ-11B_GL0069617 | --------------------------NDWLETYVLPGDKVTEEEK---------- | 563 |
| Ga0099364_10024192 | --------------------DEWLEPNMLLAQPPKEPKKDNEKYRKEPHKYSYEKDMETYRKKLREYEET | 654 |
| 530373_GL0023589 | ------------------------------------------------------ | 617 |
| emb\|ODAI011611274.1\| | AEYLQFSEEEK------------------------------------------- | 649 |
| EMG_10003641 | YQNTIDYQKIVKDFLSANKTLDCKS-------KNMQAFVSELKNAHLSENYEQREKEIYELADT | 711 |
| CasR_P1E0_metageno | ------------------------------------------------------ | 582 |
| emb\|OIZX01000427.1\| | ------------------------------------------------------ | 615 |
| 160582958_gene49834 | ------------------------------------------------------ | 667 |
| gi\|1119854231\|gb\|NFIR01000008.1\|; | ------------------------------------------------------ | 642 |
| emb\|OGNF010009141.1 | ------------------------------------------------------ | 586 |
| Ga0129306_10000735 | ------------------------------------------------------ | 617 |
| MH0288_GL0082219 | ------------------------------------------------------ | 677 |
| PIG-022_GL0026351 | ------------------------------------------------------ | 573 |
| PIG-028_GL0185479 | ------------------------------------------------------ | 575 |
| 250twins_35838_GL0110300 | -----------------------------VYGEAAYEELRKDLFERKNG | 644 |
| PIG-014_GL02226364 | ----------------------------NHNVWTDEYKSYRKECFTPKNS | 598 |
| 250twins_36050_GL0158985 | ---------------------------GNAVLTEQYKRFRYEFFEEIKR | 655 |
| emb\|OJMM01002900.1\| | ---------------------------NKPVYSEEYCAFKKDFFETCEL | 621 |

FIG. 18NN

| | | |
|---|---|---|
| emb\|OGPN01002610.1\| | ----------GKRLYTQEYKYFNDMFFNA--- | 667 |
| emb\|OHCP01000044.1\| | ----------GKKVVTKDYNNFQDMFFEG--- | 655 |
| PIG-046_GL0077813 | ----------GKVLRTKEYNNIRKMLCKK--- | 660 |
| pig_chimera | ----------GKYLYSKEYDFQYMFFKD--- | 662 |
| emb\|OIEN01002196.1\| | ------------------D------------ | 585 |
| O2.UC29-0_GL0096317 | ------------------D------------ | 572 |
| CasR_Anaerobic_dig | ------------------AN----------- | 627 |
| emb\|OGDF01008514.1\| | ------------------------------- | 611 |
| emb\|OGZC01000639.1\| | ------------------F------------ | 623 |
| Ga0224415_10048792_chimera | ------------------L------------ | 564 |
| emb\|OCVV01288914.1\| | ------------------F------------ | 565 |
| Ga0187910_10006931 | ------------------F------------ | 577 |
| R._flav_XPD_ | ------------------F------------ | 572 |
| Ga0224415_10007274 | ------------------F------------ | 555 |
| Ga0187911_10069260 | ------------------D------------ | 566 |
| Ga0187910_10015336 | ----------DWKKRTDEQQEYDRLLN---- | 670 |
| ODAI_chimera | ----------IYDRNGDIED--------EW- | 650 |
| 31009_GL0034153 | ------------------------------- | 565 |
| DLF014_GL0011914_ | ------------------------------- | 635 |
| CasR_R._albus | ------------------------------- | 620 |
| Ga0187910_10040531 | ------------------------------- | 606 |
| tpg\|DJXD01000002.1\| | ------------------i------------ | 545 |
| CasR_E._siraeum | ------------------i------------ | 615 |
| PIG-018_GL0023397 | ------------------L------------ | 603 |

FIG. 18OO

| Sequence ID | Sequence | Position |
|---|---|---|
| PIG-025_GL0099734 | ---------------------------------------------------------------i------- | 618 |
| Ga0129317_1008067_chimera | -------------------------------------------------------------------- | 544 |
| EYZ-362B_GL0088915 | -------------------------------------------------------------------- | 602 |
| uncultured_Ru_sp | -------------------------------------------------------------------- | 607 |
| R._flav._FD-1 | ---------------------------------------------------------------K------ | 611 |
| tpg\|DBYI01000091.1: | ---------------------------------------------------------------K------ | 611 |
| 037_--_emb\|OIZA01000315.1: | -------------------------------------------ADKDHQKVSTFLMNNVINNSRFKY | 644 |
| emb\|OCTW011587266.1: | -----------------------------------------------GKTKNLSAYIRNNVLENRRFKY | 588 |
| k87_11092736 | -----------------------------------------------KTVNPFRNYIAKNVITSRSFYY | 614 |
| BMZ-11B_GL0037915 | ------------------------------------------------RSNTFRNFITNNVIKSRRFVY | 597 |
| BMZ-11B_GL0037771 | -----------------------------------------------KQVNPFRNFIAGNVIESRRFMY | 602 |
| BMZ-11B_GL0069617 | -----------------------------------------------RAIKPFRNFIAMNVIESRRFMY | 585 |
| Ga0099364_10024192 | W----------------------------RSLIDYEYLMPETNPFRNFVAKQVIESRRFMY | 687 |
| 530373_GL0023589 | --------------------------------------KFNTEEARVDHTFRNFIINNVINSNRFNY | 646 |
| emb\|ODAI011611274.1: | -----------------EAFYVQEGLYGKEREKFSPYAYFHTDTSLRNFIAKNVVESARFRY | 694 |
| EMG_10003641 | NLPAYFSEEDKEKLARYIVHSDGTYKKFLKESFVAIEELPNEGFRNFISNNVINSRRFNY | 771 |
| CasR_P1E0_metageno | ---------------------------------DPETGKVRPRSDSARDTGLRNFIANNVVESRRFTY | 617 |
| emb\|OIZX01000427.1: | ---------------------------------VTGKMLPPNQRHHGDTGLRNFIANNVVESRRFQY | 649 |
| 160582958_gene49834 | ---------------------------------YTYSPSGKKIPNKNFRNFIINNVITSRRFLY | 698 |
| gi\|1198542314\|gb\|NFIR01000008.1: | -------------------------------------TKNKINDKKKGFVRYIWNNVIKSTRFRY | 671 |
| emb\|OGNF01009141.1 | ------------------------------------------FDKSASKKEKGFRNFIRNNVVDSNRFKY | 614 |
| Ga0129306_1000735 | ----------------------MLDKTKLRLLPDGKVDTGFRNFIISNVTESRRFRY | 652 |

FIG. 18PP

```
MH0288_GL0082219               ------------------------K---MSLKWTKDGQEADTGFRNFIISNVLKSSRFRY  710
PIG-022_GL0026351              ----------------------------KKTRLNARSKADTGLRNFIISNVIKSSRFKY  604
PIG-028_GL0185479              ----------------------------KKTRLIARSKADMGLRNFIISNVIKSSRFKY  606
250twins_35838_GL0110300       T---------------------------KY----NKKGKKVDVYDHKFRNFLINNVIKSKWFFY  677
PIG-014_GL0226364              D---------------------------SM----NDAEKSFVAKGHQKRNFIISNVVLNKRFLY  631
250twins_36050_GL0158985       D---------------------------ESGGIKYKKSGKPEYNHQRRNFILNNVLKSKWFFY  691
emb|OJMM01002900.1|            D---------------------------EFGRVKYNKKGKPVINHRRRNFINNVLSSKWFFY  657
emb|OGPN01002610.1|            ----------------------------GNHKVRNFIANNVMQSKWFFY              688
emb|OHCP01000044.1|            ----------------------------KNHRVRNFVSNNVIKSKWFSY              676
PIG-046_GL0077813              ----------------------------DRRLNFIANSIIKNKWFSY               679
pig_chimera                    ----------------------------SHRVRNFISNSVIKSKWFSY              682
emb|OIEN01002196.1|             ----------------------------NRSGATGKNAGKDHNLRNFLVSNVIRSRKFNY  617
O2.UC29-0_GL0096317            ----------------------------DC----KDVKHADHNLRNFIVTNVIKSRKFNY  600
CasR_Anaerobic_dig             ----------------------------KKIINKINGTKEDRNLRNFIINNVVKSRRFQY  659
emb|OGDF01008514.1|            ----------------------------YVSSKLLGGADKNLRNFITNNVIKNRRFLY   641
emb|OGZC01000639.1|            ----------------------------FRDKNGKKLNTGEHGMRNFIGNNVISNTRFQY  655
Ga0224415_10048792_chimera     ----------------------------FKDENGKLLGMKQHGMRNFIGNNVIKSKRFHY  596
emb|OCVV012889144.1|           ----------------------------FNDSEGNLLKKGKHGMRNFIINNVIENKRFHY  597
Ga0187910_10006931             ----------------------------FKDSNGKLLHKGKHGMRNFIINNVVNNKRFHY  609
R._flav_XPD_                   ----------------------------SLDENGNKLKKGKHGMRNFIINNVISNKRFHY  604
Ga0224415_10007274             ----------------------------SLDENGNKLGKGKHGMRNFIINNVITNKRFHY  587
Ga0187911_10069260             ----------------------------YNQNGEKIKVRVDFGFRNFIANNVVESSRFHY  598
Ga0187910_10015336             ----------------------------KHHYFKSGKKLPDTGLRNFIINNVIESRRFNY  702
ODAI_chimera                   ----------------------------KKGKLVHKKDEKKGVYNFIATNVIESNRFQY  682
```

FIG. 18QQ

```
31009_GL0034153              ----------------------------QKDNKNAKKDFRNFIKNVIKSNRFIY  592
DLF014_GL0011914_            ----------------------------SKEDKGIKKDFRNFIKNIIKSNRFMY  662
CasR_R._albus                --------------------LDKEGNKLKGARHDFRNFIANNVIKSSRFKY      651
Ga0187910_10040531           --------------------IGADGKPIKNANKGFRNFIASNVIESSRFRY      637
tpg|DJXD01000002.1|          --------------------PVGADGKFIKGKQGFRNFIASNVIESSRFHY      576
CasR_E._siraeum              --------------------DANGD--KKLKKNNGLRNFIASNVIDSNRFKY      645
PIG-018_GL0023397            --------------------DANGERISKNQRENGLRNFIASNVIDSNRFKY      635
PIG-025_GL0099734            --------------------GADGKPVKMAKGKRGFRNFIISNVLKSSRFRY      650
Ga0129317_1008067_chimera    --------------------YDKSGKKLAQSKKGFRNFINNVVESSRFKY       575
EYZ-362B_GL0088915            --------------------QYFQKGARHDFRNFINNVINSTRFIY           629
uncultured_Ru_sp             --------------------LKEKGKGIHGLRNFITNNVIESSRFVY          634
R._flav._FD-1                --------------------KTDPVTGKPLKGKNPLRNFIANNVIENSRFIY     643
tpg|DBYI01000091.1|          --------------------KINPVTGKIEKGKNPFRNFIANNVIENKRFIY    643
                                                  ::  .:  .  *  .  *

037_--_emb|OIZA01000315.i|  VVKYINPADINGLAKNRYLVKFVLSKIPE---E--------QIDSYYKLFSNEEE---  688
emb|OCTW011587266.1|         VIKYIHPSDVQKIACNKAIAGFVLNRMPD---T--------QIKRYIDSLINKGA--  632
k87_11092736                LVRYAKFTAVRKLMSNPKIVRYVLKRLPE--------------KQVASYYSAIWTQSES----  659
BMZ-11B_GL0037915           LVRYTKADAVRAVMKNGKIVRYLARIFE----------------TQVDSYYKSVVDSSD---  641
BMZ-11B_GL0037771           LVRYSKPKAVRAIMQNRSIVNYVLHRLPS--------------EQIKTYSRVFPEDF------  645
BMZ-11B_GL0069617           LARYAKPKSVRELMKHEEIIRYVLTRLPE---------------KQIDTYFSNISEGDE----  629
Ga0099364_10024192          LVRYTKPKTVRALMSNRAIVHYVLSRIAD---I---QDHHMTESQIDRYYQNLPQYNEQ---  740
530373_GL0023589            VMRFMNPKSARRIMQCESLVAFSLKDIPD---T-------------QIERYCKSVNIPFDS----  691
emb|ODAI01161127.1|         VIRYVSPEIARKYARQEALVRFALHRVPL---L---------QLRRYYQSCCGPKKD---  739
```

FIG. 18RR

```
EMG_10003641                      IMRFCNPEKIANIGKNKVLISFALSSLAEKTD----------MIAKYYRVFCDRID----  817
CasR_P1E0_metageno                LLRYMTPEQARVLAQNEKLIAFVLSTVPD---T---------QLERYCRTCGREDI----  661
emb|OIZX01000427.1|               LIRYSDPAQLHQLASNKKLVRFVLSSIPD---T---------QINRYYETCGQTRL----  693
160582958_gene49834               LIRYGNPEKIRKIAINPSIISFVLKQIPD---E---------QIKRYYPPCIGKRT----  742
gi|1198542314|gb|NFIR01000008.1|  LVRYADPKKVRAFAANKKVVAFVLKDIPD---D---------QIRAYYNSCFRQNSDSSS  719
emb|OGNF01009141.1|               LTRYTDTSSVKAFSNNKALVKFAIKDIPQ---E---------QLRYNSCFGASER-----  659
Ga0129306_1000735                 LVRYCEPRAVRDYMSCRPLIRLTLRDMPD---T---------LLRRYEQSVGAAT-----  696
MH0288_GL0082219                  VVRYGNPKKLREVMQNEAVVKFVLNDLPE---E---------QINRYSENILGLDA----  754
PIG-022_GL0026351                 LIRYSNPKKVKAIAENKKLVRFVLDKIPD---P---------QIIRYCNTCGF-KV----  647
PIG-028_GL0185479                 LIRYSNPKKVKAIAENKKLVSFVLDKIPD---T---------QIIRYCNTCGF-KV----  649
250twins_35838_GL0110300          IAKYVKFADCAKMMSNKKMIEFALRDLPE---T---------QIKRYYTITGNEA-----  721
PIG-014_GL0226364                 VAKYGSPTACNQMMKNQKIVRMALESISE---D---------QLRKYARRVYDNKEH---  676
250twins_36050_GL0158985          VVKYNRPSSCRELMKNKEILRFVLRDIPD---S---------QVRRYFKAVQGEEA----  735
emb|OJMM01002900.1|               VAKYNRPSECQKFMKSKKLIALVLKDVPE---T---------QIARYYQSVTGGRI----  701
emb|OGPN01002610.1|               VVRYNKPAECQIIMRNKTLVKFTLDDLPD---M---------QIQRYYSSVFGDNN----  732
emb|OHCF01006044.1|               VVRYNKPAECQALMRNSKLVKFALDELPD---S---------QIEKYYISVFGEKS----  720
PIG-046_GL0077813                 IVRYNQPSECQAIMKNKTLVKFALDELPD---L---------QIQRYFVALYGDED----  723
pig_chimera                       IVRYNQPSECRAIMKNKTLVKFALDELPD---L---------QIQRYFVALYGDED----  726
emb|OIEN01002196.1|               LSRYSNLAEVKKLAQNPSLVQFVLSRIEP---S---------LICRYYESSQGIS-----  660
02.UC29-0_GL0096317               LARYSDMATVSKLSKNKEVVKFVLKRVDP---K---------QIERYRSVCDVR------  643
CasR_Anaerobic_dig                IARHMNTHYVKQLANNETLNRFVLNKMGD---A---------KIINRYYESISGNT----  703
emb|OGDF01008514.1|               TVRYMNPKRAKKLVQNDALVVLALSGIPE---T---------QIDRYYKSCIEKR-----  684
emb|OGZC01000639.1|               LIRYCNPQKLHTLSQNETVVRFVLSRIAK---NQRVQGMNGKNQIDRYYETCGGTN----  708
Ga0224415_10048792_chimera        LIRYGDPAHLHKIATNKNVVRFVLGRIAD---MQKKGQQKGKNQIDRYYEVCVGNK----  649
```

FIG. 18SS

| | | |
|---|---|---|
| emb\|OCVV012889144.1\| | LIRYGDPAHLHEIAKNEAVVRFVLGRIAD---IQKKQGKGDGKNQIDRYYEICVGKD---------- | 650 |
| Ga0187910_10006931 | IIRYGDPAHLHEIAKNEVVVRFVLGRIAD---IQKKQGKGGKNQIDRYYEICIGNG---------- | 662 |
| R._flav_XPD_ | LIRYGDPAHLHEIAKNEAVVKFVLGRIAD---IQKKQGQNGKNQIDRYYEICIGKD---------- | 657 |
| Ga0224415_10067274 | LIRYGNPVHLHEIAKNEAVVKFVLGRIAD---IQKKQGQNGKNQIDRYYEICIGKD---------- | 640 |
| Ga0187911_10069260 | LIRYCHPRKIRNLAGNAALIEYQLRRLPE---L-----------QILRYYEACTEPIK-------- | 642 |
| Ga0187910_10015336 | IVRYADPKKIRKCTENNELLKFAFKDVPD---S-----------QVDRYYNICVTNK--------- | 745 |
| ODAI_chimera | IVRYANTEKIAALARMETIVRFVKKLPA---A-----------QIVRYYIACNRIREN------- | 727 |
| 31009_GL0034153 | LIKYSNPTNVRKFASNTNVIKFVLGTLPD---K-----------QIERYYKSCGLSD--------- | 635 |
| DLF014_GL0011914_ | LVKYSNPTDVRNLASNRNVVKFVLNAIPD---T-----------QIDRYYKSCIQHY--------- | 705 |
| CasR_R._albus | LVKYSSADGMIKLKTMEKLIGFVLDKLPE---T-----------QIDRYYESCGLD---------- | 693 |
| Ga0187910_10040531 | LVRYNNPHKTRMIAQNEAIVRFVLSEIPD---E-----------QIRRYYDVCRDPK--------- | 680 |
| tpg\|DJXD01000602.1\| | LVRYNNPHKTRTLVKNPNVVKFVLEGIPE---T-----------QIKRYFDVCKGQE--------- | 619 |
| CasR_E._siraeum | LVRYGNPKKIRETAKCKPAVRFVLNEIPD---A-----------QIERYYEACCPKN--------- | 688 |
| PIG-018_GL0023397 | LVRYGNPKKIRETAKCPPAVRFVLDGIPD---S-----------QIERYNSCFPED--------- | 678 |
| PIG-025_GL0099734 | LVKYCNPKKIRKIANNEKIVKFVLGRITE---T-----------QIERYYSCNPELK--------- | 694 |
| Ga0129317_1008067_chimera | IVRYSNPQKIRKLANNSVVVGFVLGKLPD---A-----------QIESYFNSCLPN--------- | 617 |
| EYZ-362B_GL0088915 | VIKFCNPKTAGQIIRNENILRFVLQRMPQ---E-----------QIERYYHACTKN--------- | 671 |
| uncultured_Ru_sp | LIKYANAQKIREVAKNEKVVMFVLGGIPD---T-----------QIBRYYKSCVEFP-------- | 677 |
| R._flav_FD-1 | LIKFCNPENVRKIVNNTKVTEFVLKRIPD---A-----------QIERYYKSCTDS--------- | 685 |
| tpg\|DBY101000691.1\| | VIKFCNPKNVRKLVNNTKVTEFVLKRMPE---T-----------QIDRYFESCIEG--------- | 685 |
| | :     :                 : :  *               :               | |
| 037---emb\|OIZA01000315.1\| | -----------------------PSCEEKIKLJLTKKISKLNFQTLFENNK--------------- | 715 |
| emb\|OCTW011587266.1\| | ------TDIQAQAKALLDCITGISFDAIRDDKHLHKS-------------------------KE | 665 |

FIG. 18TT

| | | |
|---|---|---|
| k87_11092736 | ------------------NSNEMVKLIEMIDRLTTEIAGFSFAVLKDKKDSIVSA---------SR | 698 |
| BMZ-11B_GL0037915 | --------------------AGNGKPIKEKIKALAEKLGEFSFDLIAENRDGIIDNA------KL | 680 |
| BMZ-11B_GL0037771 | --------------------SDTEAEIDFLVNKLSEFSFETFISNQQTILNNS-----KRGFSP | 684 |
| BMZ-11B_GL0069617 | ---------------------SEISRKIDTLIKALTGFSFNSLFINRDKIVENT------KL | 664 |
| Ga0099364_10024192 | --------------------QHKNVSLETKIDALADYLCKYTFEKNVLKQKNGIV-L------NT | 778 |
| 530373_GL0023589 | ----------------------ANPNYAHMKEQLTYKLLQVFCNFSKVSNSSHQ----------- | 724 |
| emb:ODAI011611274.1 | ---------------------PDAAECVDFLAGVVNRVDFANFTDVRTGDSSK----------- | 771 |
| EMG_10003641 | ---------------------DQKTMEDYLVNKLTKISYTEFLNVNQKANAE----------- | 848 |
| CasR_P1E0_metageno | ---------------------TGRPAQIRYLTAQIMGVRYESFTDVEQRGRG----------- | 692 |
| emb:OIZX01000427.1 | ---------------------AGRAAKVEFLTDMIAAIRFDQFRDVNQKERG----------- | 724 |
| 160582958_gene49834 | ---------------------DDVTLMRDELGKMLQSVNFEQFSRVNNKQNAK---------- | 774 |
| gi|1198542314|gb|NFIR01000008.1| | NNSNASWDADSNKRDISVSDMRKALTEKITGLNFGDFEEESKKGIR---------- | 765 |
| emb:OGNF01009141.1 | ---------------------YYNDGMSDKLVEAIGKINLMQFNGVIQQADRN------MLPE | 695 |
| Ga0129306_1000735 | ---------------------VDRERILDTLADKLLSLRFTDFENVNQRANAE---------- | 728 |
| MH0288_GL0082219 | ---------------------AAKEKKVSELARFLRALSLEDFRDVEQSANAA---------- | 786 |
| PIG-022_GL0026351 | --------------------GERQENINTLAKAITNFSFSAFEKVKQSANVE-------N--- | 680 |
| PIG-028_GL0185479 | --------------------GKRQENINTLAEAITYFSFSNFEKVKQSANVE-------N--- | 682 |
| 250twins_35838_GL0110300 | -------------------LGDAESLKGVIIEQLHAFSIKNTLLSIKNM--G------EGEY | 756 |
| PIG-014_GL0226364 | --------------------FQNQTADEIRENLAKKLKNFNIGAELKTVGNL------SEKD | 712 |
| 250twins_36050_GL0158985 | --------------------YASAEAMRTRLVDALSQFSVTACLDEVGGM--T------DKEF | 770 |
| emb:OJMM01002900.1 | --------------------QANSEAMRMTLIKLLHEFSIKNVLSDVGTM--T------ASEN | 736 |
| emb:OGPN01002610.1 | --------------------MPAVDEMRKRLLDKINQFSVRGFLDELDEIVLM------SDEE | 769 |
| emb:OHCF01000044.1 | ---------------------SSSNEEMRRELLKKLLCDFSVRGFLDEIVLL--S-----EDEM | 755 |
| PIG-046_GL0077813 | ---------------------LPSYGEMRKILLHDFSIRDFDEEIGSL-----F------D-EM | 757 |

FIG. 18UU

| | | |
|---|---|---|
| pig_chimera | ----------LPSYGEMRKILLKKLHDFSIKGFLDEIVLL---S----------DLDM | 761 |
| emb\|OIEN01002196.1\| | ----------SEGITIDEQIKKLTGIIVDMNIDSFENINNGEIGMR------Y-----SK | 699 |
| O2.UC29-0_GL0096317 | --------NISAEDEIEKLVDIIYNFNIDELEQVNNAEIGTG------HSGRKV | 683 |
| CasR_Anaerobic_dig | ----------PNIEVRSQIDYLVKRLRSFSFEDLNDVKQKVRPG----------- | 737 |
| emb\|OGDF01008514.1\| | --------SFNPDLNEKIAALSEMITTLKIDDFEDVKQNPEKNA--------NYE | 723 |
| emb\|OGZC01000639.1 | ----------SWSVSEEEKINFLCKILTNMSYDQFQDVKQSGAEI---------- | 743 |
| Ga0224415_10048792_chimera | --------DIKKTIEEKIDALTDIIVNMNYDQFEKKKAVIENQ-----NRGKTFEEKN | 694 |
| emb\|OCVV012889144.1\| | ------RGKTVSQKLDELTKIIVNMNYDQFEQKKEIIENTRTKYMRYDEEQ | 697 |
| Ga0187910_10006931 | ----------YGKSVSEKIDALTKVIINMNYDQFEAKRKVIENT------------ | 696 |
| R._flav_XPD_ | ----------KGKSVSEKVDALTKIITGMNYDQFDKKRSVIEDT------------ | 691 |
| Ga0224415_10007274 | --------SSKSVAEKVNALTKIITGMNYDQFDSRRNVIENT------------ | 674 |
| Ga0187911_10069260 | ------RTARIMDEKIGTLIDLIVKMDFSQFEDVQQNDRVRV------FSDAEKK | 685 |
| Ga0187910_10015336 | --------ITNATREEKIERLVDIIKSMNLSKVATVKQRDKQ------------- | 779 |
| ODAI_chimera | --------INSNVLTSDDMAESLVKLVTGMDFGKIKGVRNDDR----------- | 762 |
| 31009_GL0034153 | ----------GIGKTEWVRELSEIITGIDYSDFLNVKQRAKS-------------- | 667 |
| DLF014_GL0011914 | ----------SNEVDKETQIQELTDIITGIDYLDFLDVRQSYR------------- | 738 |
| CasR_R._albus | --------NAVVDKKVRIEKLSGLIRDMKFDDFSGVKTSNKA------------- | 727 |
| Ga0187910_10040531 | ------LPRSSSREAQVDILTGIITDVNYRIFEDVPQSKKINK-----DRPD--- | 721 |
| tpg\|DJXD01000002.1\| | ------IPPTSDKSAQIDVLARIISSVDYKIFEDVPQSAKINK-----DDPS--- | 660 |
| CasR_E._siraeum | --------TALCSANKRREKLADMIAEIKFENFSDAGNYQKANV------TS---- | 726 |
| PIG-018_GL0023397 | --------TAICSADKKRRELAEMISNISFDWFKDAGNVQRVNA------ED---- | 716 |
| PIG-025_GL0099734 | ------RAAYPGREAAIDDLTKIIINMKFDDFKNVKQSANV------ED------ | 731 |
| Ga0129317_1008067_chimera | ------RVYSTPDKARESLRDMLHNISFNDFADVKQDDRR------A-------- | 652 |
| EYZ-362B_GL0088915 | --------PSLCTHDEKIQCLSNIIMEVRYKKFCNVAQKSRD------T------- | 706 |

FIG. 18VV

```
uncultured_Ru_sp              -------------------------DMNSSLGVKRSELARMIKNISFDDFKNVKQQAKG---------------------  711
R._flav._FD-1                 -------------------------EMNPPTEKKITELAGKLKDMNFGNFRNVRQSAK---------------------  718
tpg|DBYI01000091.1|           --------------------NLNPTTEKKIEKLAEMIKNIKFEEFRNVKQKVRD-------N-----------------  720

037_--_emb|OIZA01000315.1|    ----IPNVEKERKKAIITLYFTIVYILVKNLVNINGLYTLALYFVERDGFFYKQICEKKLI                   772
emb|OCTW01158726.1|           KSPQRSADRERKKAMLTLYYTIVYIFVKQMLHINSLYTIGFFYLERDQRFIYSRAKKEN-                    724
k87_11092736                  ESRAVNLEVERLKKLTTLMSIAYIAVKSLVKVNARYFIAYSALERDLYFNEKYGEEFR                      758
BMZ-11B_GL0037915             DEEKKNVEIERLKAVTGLYLTVAFIAIKNLVKANARYYIAYSAFERDSELLKEKLGEEEF                    740
BMZ-11B_GL0037771             NRRETAEEIERLKATTGLYLSVAYIAIKNIVKANARYYIAFAVFERDKELVKAKDAR---                    741
BMZ-11B_GL0069617             DTSNKNVKIERLKALTGLYLTVAFVAVKNLVKANARYFIAFSAFERDYGFMKSHDPD---V                   722
Ga0099364_10024192            KSATKNVEIEHLKALTGLYLTVAYIAVKNLVKANARYYIAFSIFERDYALFEKKLIGKDTL                   838
530373_GL0023589              --------AVEKERLKALVGLYLSVLYRIVKSIVRINTSYTIAFAAYERDCVILNRKMGKNLY                 779
emb|ODAI01161127.1|           ------SEQEKKQKYQAIVGLYLTVVGLYLTVVYWIVKNLVNVNSRYVMAFHILERDTVLLEGKRLFVGG          828
EMG_10003641                  ---------KNKEKDRSQKLIGLYITLLYEIVKNLVNINSRYNIAFQRCDNDSIMILQGQYDER-               903
CasR_P1E0_metageno            -----DNPKKERYKALIGLYLTLYLYLAVKNMVNCNARYVIAFYCRDRDTALYQKEVCWYDL                  748
emb|OIZX01000427.1|           -----ANTQKERYKAMLGLYQTVLYLTVLYLAVKNLVNINARYVMAFHCVERDMFLYDGELTDPKG              780
160582958_gene49834           ----QNPNGEKARLQACVRLYLTVPYLFIKNMVNINARYVLAFHCLERDHALCFNSRKLN---                 830
gi|1198542314|gb|NFIR01000008.1| ------KEESDKNIIRLYLTLYLVQKNLIYVNSRYFLAFHCAERDEMLYNGETIDNNK                   818
emb|OGNF01009141.1|           EKKKANAQKEKYKSIIRLYLTTVCYLFFKNLVYVNSRYYSAFYNLEKDRSLFEINGELKPT                   755
Ga0129306_1000735             -----RNREKQKMMGIISLYLNVAYQIVKNLVYVNARYTMAYHCAERDTELLLNAAGEGNL                   784
MH0288_GL0082219              -----RNARKARYQGAMSLYLNVIYQIIKNMVYINSRYTLAFAKYEHDASLLLDNWVYDPY                   842
PIG-022_GL0026351             --DTPDAIDKAQKQGLISLYLTVLYLFIKNMVYLFIKNMVYVNSRYVLAFHCLERDSQLLKITSGYN---          737
PIG-028_GL0185479             --DTPDAIDKAQKQGLISLYLTVLYLFIKNMVYLFIKNMVYVNSRYVLAFHCLERDSQLLKITSGYN---          739
```

FIG. 18WW

| 250twins_35838_GL0110300 | KIQQIGSSKEKLKAIVNLYLTVAYLLTKSLVKVNIRFSIAFGCLERDVLQKKS--------- | 810 |
| PIG-014_GL0226364 | FRSSKNALKDKSKSLIGLYLTVAYLITKNMIKINTRFSIAFGAYERDMEFLLQQ-------- | 766 |
| 250twins_36050_GL0158985 | ASQRAVDSKEKLRAIIRLYLTVAYLITKSMVKVNTRFSIAFSVLERDYYLLIDG-------- | 824 |
| emb\|OJMM01002900.1\| | KRQIENSRKEKMKAIVKLYLTVVLIAKSLVKVNTRFSIAFSAYERDVSLLADENELIA---- | 795 |
| emb\|OGPN01002610.1\| | SKRNKSSEKEQKKSLIRLYLTIAYLITKSMVKINTRFSIACAMYERDYALLCQS-------- | 823 |
| emb\|OHCP01000044.1\| | KQRDKFSEKEKKKSLIRLYLTIVLLITKSMVKINTRFSIACATYERDYILLCQS-------- | 809 |
| PIG-046_GL0077813 | KRKDKFCESDRKKCLIFRLYLTIAYLITKSMVKINTRFSIACATYERDYALLCAS------- | 811 |
| pig_chimera | ESQDKYCEKEQKKSLFRLYLTIAYLITKSMVKINTRFSIACATYERDYALLCAS-------- | 815 |
| emb\|OIEN01002196.1\| | ATPQSIERRNQMRVCVGLYLNVLYQIEKNLMNVNARYVLAFAFAERDALMLNFTLEECK--- | 758 |
| O2.UC29-0_GL0096317 | ASKRSVQERNQARACVSLYLNVLYQIVKNLMNVNSRYSIAFAMTERDMIVEGKGIEAIET-- | 743 |
| CasR_Anaerobic_dig | --TNESIERKEKKKALVGLCLTIQYLVYKNLVNINARYTTAFYCLERDSKLKGFGVDVWR-- | 794 |
| emb\|OGDF01008514.1\| | AKKNQRISKERYKACIGLYLTVLYLICKNLVKINARYSIAIGCLERDTQLHGVDFKGAA--- | 782 |
| emb\|OGZC01000639.1\| | -TAEEKRKKERYKAIISLYLTVLYQLIKNLVNINARYIIAFHCLERDAILYSSKFNTSIN-- | 802 |
| Ga0224415_10048792_chimera | KYKRDNAERERKFKKIISLYLTVIYHILKNIVNSRYILGFHCLERDKQLYIEKYNKD----- | 752 |
| emb\|OCVV012889144.1\| | KLRKDNAEREKFKKIISLYLTVIYHILKNIVNVNSRYVIGFHCLERDAQLYSEKYNKE---- | 755 |
| Ga0187910_10006931 | --GRDNAEREKYKKIISLYLTVIYQILKNIVNVNSRYVIGFHCVERDAQLYKEKGYDINT-- | 754 |
| R._flav_XPD_ | --GRENAEREKFKKIISLYLTVIYHILKNIVNINSRYVIGFHCVERDAQLYKEKGYDINL-- | 749 |
| Ga0224415_10007274 | --GAGNAEREKYKKISLYLTVINIVKNIVNINARYVMAFQAWERDNYLLQLSGKE------- | 732 |
| Ga0187911_10069260 | EKIRKMREKQRYQSIISLYLTMLYLIVKNLVNINARYVMAFQAWERDNYLLQLSGKE----- | 743 |
| Ga0187910_10015336 | ---DNVEKQKQLAIMSLYLNLIVYQIAKNLVYYNSRYVMAFHSLERDSQMLFDAYYDV---- | 833 |
| ODAl_chimera | -------SGDKEMKKAIVTLYLTILYHLITKNLNLVYVNSRYFMAFHCLERDMNLFGEGQKQALR | 817 |
| 31009_GL0034153 | --KEEKEDKAKKQAIVTLYLTILYLILTKNLVNVNSRYIAVHCIERDSELYKTELYEKLK-- | 725 |
| DLF014_GL0011914_ | ------NEDKSKKQAVVTLYLTILYILTKNLVNVNSRYVIALHCLERDSKLYGYTKLSKKN | 793 |
| CasR_R._albus | --GDNDKQDKAKYQAIISLYLMVLYQIVKNMIYVNSRYVIAFHCLERDFGMYGKDFGKY--- | 784 |

FIG. 18XX

| | | |
|---|---|---|
| Ga0187910_10040531 | ANDRMTLKKQRYQAIVSLYLTVMYLVIKNLVYVNSRYVMAFHALERDAYLYGITNI--------- | 777 |
| tpg\|DUXD01000002.1\| | RNFSDALKKQRYQAIVSLYLTVMYLIIKNLVYVNSRYVIAFHCLERDAFLHGVILPKM------- | 718 |
| CasR_E._siraeum | -RTSEAEIKRKMQAIIRLYLTVMYIMLKNLVNVNARYVIAFHCVERDTKLYAESGLEVG------ | 784 |
| PIG-018_GL0023397 | -KSRNAEIKRKMQAIIRLYLTVMYLTVMYLMLKNLVNVNSRYVIGFHCVERDAKLYKLSGLTIE- | 774 |
| PIG-025_GL0099734 | -SSKEAQEKMKYQTIISLYLTVCYHLVKNLVNIINARYAMAFHSLERDARLYGIYGSEKDY---- | 790 |
| Ga0129317_1008067_chimera | -TPEEKVEKERYKAIIGLYLTVMYHLVKNLVYVNSRYVMAFHCLERDAMHYDVS----------- | 705 |
| EYZ-362B_GL0088915 | ----TKQMEKERFKAIIRLYLTAIYLVVRNLVNVNARYVLAFHCLERDADLFGLQIKQTLP---- | 763 |
| uncultured_Ru_sp | ----RENVAKERAKAVIGLYLTVMLLVVKNLVNVNARYVIAIHCLERDFGLYKEIIPEL--A--- | 767 |
| R._flav._FD-1 | ---------ENMEKERFKAVIGLYLTVVYRVKNLVDVNSRYIMAFHSLERDSQLYNVS------- | 768 |
| tpg\|DBYI01000091.1\| | ---SQEAVEKERFKAIIGLYLTVIYLLVKNLVNVNSRYVMAFHCLERDAKLYGVQ---------- | 772 |
| | * : * *.:: * : : .*   :.* | |
| | | |
| 037_-_embl\|OIZA01000315.1\| | -------------------------ETLKKKDKKQLYNDDYLLLPELFSGSKYRE---------- | 803 |
| embl\|OCTW011587266.1\| | -----------------------------KNPSKNSYLNDFRSVTAYFIPSEIMKRIEKNE--- | 756 |
| k87_11092736 | --------------------LHFIP---YELNGKTCQFEYLAILKYLARDEETLKRKCEICEEIKVG | 803 |
| BMZ-11B_GL0037915 | --------------------YKLCIEPKN----KKGEIGYNNAFALLKYYIDRDEDIWRKEEATHRGRDEN | 787 |
| BMZ-11B_GL0037771 | -------------------------IQTTIPNTKFTNFCLTQYYLDRDEEKKFPGDPRDKEAFFE | 782 |
| BMZ-11B_GL0069617 | --------------------AQSCLAYEEIMDGKSKTKYNEIYALIEYLKKEEENDYHPEPGQPFDKEA | 772 |
| Ga0099364_10024192 | ----------------EKYVKPFKYIDKGEEKEGKNNFFALTEYLLDKDNSLRYQWMNDLSDEENK | 888 |
| 530373_GL0023589 | GL-----------------------KTDPMGITNDFMHMPTVAPSNPH----------------- | 804 |
| embl\|ODAI01161127.1\| | MK-------------------------AEDPPLLTDGYVSRQDAYVRK----------------- | 851 |
| EMG_1000364i | -------------------------AVQESKLTKKFISNQK---------------------- | 919 |
| CasR_PiEO_metageno | EE------------------DKKSGKQRQVEDYIALTRFVSQGY-------------------- | 775 |
| embl\|OIZX01000427.1\| | ES-------------------VSAFLAVNGKKGVQPQILLLTQLFIRRDY-------------- | 811 |

FIG. 18YY

| | | |
|---|---|---|
| 160582958_gene49834 | ----------------------DDSYNEMANKFQMVRKAKKEQYEKEYKCK------ | 859 |
| gi\|1119854231\|gb\|NFIR01000008.1\| | EK---------------------GSEKDWRKFAKQFIMEHS--------------- | 838 |
| emb\|OGNF01009141.1\| | GK---------------------FDEGHYTGLVKLFIDNGW--------------- | 775 |
| Ga0129306_1000735 | LRRDRSWPARLHLPRRALARRRDRVEVMERDVARGPEAYNRDEWLG----------- | 830 |
| MH0288_GL0082219 | ----------------------KTVFSDLTEDSLQKGK------------------ | 858 |
| PIG-022_GL0026351 | ----------------------NSSYNNLTNYFIDNKY------------------ | 753 |
| PIG-028_GL0185479 | ----------------------NLSYNNLTNHFIEKEY------------------ | 755 |
| 250twins_35838_GL0110300 | ----------------------EKKFDAIINELLLEDDKIRKECDKERAQAKTL--- | 842 |
| PIG-014_GL0226364 | ----------------------KKEKGKRFDWLALTQKFLSEDKNYYFEHDLRRKEINKI | 804 |
| 250twins_36050_GL0158985 | ----------------------KKKSSDYTGEDMLATRKFVGEDAGLYREWKEKNAEAKDK | 864 |
| emb\|OJMM01002900.1\| | ----------------------LANNEDDKWKKGNYVFALTKHFWDNDEPYFDKYNNALQQIRSI | 838 |
| emb\|OGPN01002610.1\| | ----------------------EMKGGPWDGGAQALAVTRKFLNHDREVFDRYCAREAEIARL | 864 |
| emb\|OHCP01000044.1\| | ----------------------EKAERAWEKGATAFALTRKFLNHDKPTFEQYYTREREISAM | 850 |
| PIG-046_GL0077813 | ----------------------NKQERAWSSGATALALTRKFLNQDKLIFEKHYAREGEISKL | 852 |
| pig_chimera | ----------------------NKQERAWSSGATALALTRRFLNQDKLIFEKHYAREGEISKL | 856 |
| emb\|OIEN01002196.1\| | ----------------------KNKKRSSGGFSFIEMTQFFIDKKLFKVAT----- | 787 |
| O2.UC29-0_GL0096317 | FKDDP------------------DAGKKSKKQIAYRTKYIALTEEYLDKGYIKCAT- | 781 |
| CasR_Anaerobic_dig | ----------------------DFESYTALTNHFIKEGY----------------- | 811 |
| emb\|OGDF01008514.1\| | ----------------------YMTRDVFIAKGWI--------------------- | 795 |
| emb\|OGZC01000639.1\| | ----------------------LKKRYTALTEMILGYETDEKAR------------ | 824 |
| Ga0224415_10048792_chimera | ----------------------KLDGFVALTKFCLGDEERFEDL----------KAK | 777 |
| emb\|OCVV012889144.1\| | ----------------------IDKKISSLTKFCLGESDEKKLK----------AL | 779 |
| Ga0187910_1000693 | ----------------------NNLESKGFTSVTKLCVGIADDDPVKYRNVEIELKER | 790 |
| R._flav_XPD_ | ----------------------KKLEEKGFSSVTKLCAGIDETAPDKRKDVEKEMAER | 785 |

FIG. 18ZZ

| | | |
|---|---|---|
| Ga0224415_10007274 | ----------------------KKLKDKGFTSVIKLCAGIDEECK-----DVEKEMTER | 764 |
| Ga0187911_10069260 | ----------------------AEAEYLNLTRHFIEPLDGAKP-------------- | 764 |
| Ga0187910_10015336 | ----------------------KRGYCDLSTVLLFGVDDLQNRRGSYKYLRDN----- | 865 |
| ODAI_chimera | NTGDY-----------PADN--ADLRRRDIKYCVLTKAHIKQEEVKSRRND------- | 855 |
| 31009_GL0034153 | PEQPE-----------KLYKIKPDKPLQPAQYFLFTKYLLQNDFFGE----------- | 761 |
| DLF014_GL0011914 | ----------------NKKLEKIRPPKYHELTKYFIDNRYFDRK------------- | 821 |
| CasR_R._albus | ------------------------YQGCRKLTDHFIEEKYMKE-------------- | 803 |
| Ga0187910_10040531 | ------------------------KGDYRKLTDNLLADENYKKF------------- | 797 |
| tpg|DJXD01000002.1| | ------------------------NKKIVYSQLTHLLTDKNYTY------------- | 740 |
| CasR_E._siraeum | ----------------------NIEKNKTNLTMAVMGVKLENG-----IIKT----- | 809 |
| PIG-018_GL0023397 | ----------------------GNTDKNRTLLTATILGITSADRAPSGEIVA----- | 804 |
| PIG-025_GL0099734 | V---------------------EKLKKEQAVLVEKLLSDGPETAG------------ | 814 |
| Ga0129317_1008067_chimera | ----------------------LDNYRDLIRHLISEGDSSCN--------------- | 725 |
| EYZ-362B_GL0088915 | D---------------------RKKKSDYLKLAVDQCGDNPENKP------------ | 787 |
| uncultured_Ru_sp | S---------------------KNLKNDYRILSQTLCELCDKSPN----------- | 791 |
| R._flav._FD-1 | ----------------------VDNDYLALTDTLVKEGDNSRS-------------- | 789 |
| tpg|DBYI01000091.1| | ----------------------NIGGDYLALTAKLCAEGDDYGKKLSEAKQ------ | 801 |
| 037_---_emb|OIZA01000315.1| | --------------------------------------------------------- | 803 |
| emb|OCTW011587266.1| | --------------------------------------------------------- | 756 |
| k87_11092736 | CEKHKKNANPPYEYDQEWIDKKKALNSE---RKACERRLHF--------------STH | 844 |
| BMZ-11B_GL0037915 | GKLDYDPDP------------------------------------------------ | 796 |
| BMZ-11B_GL0037771 | ------HL------------------------------------------------- | 784 |

FIG. 18AAA

| | | |
|---|---|---|
| BMZ-11B_GL0069617 | CRKHLD------------------------------------------------ | 778 |
| Ga0099364_10024192 | QALRKHLDKKE------------------------------------------- | 899 |
| 530373_GL0023589 | ------------------------------------------------------ | 804 |
| emb\|ODAI011611274.1\| | ------------------------------------------------------ | 851 |
| EMG_10003641 | ------------------------------------------------------ | 919 |
| CasR_P1E0_metageno | ------------------------------------------------------ | 775 |
| emb\|OIZX01000427.1\| | ------------------------------------------------------ | 811 |
| 1605B2958_gene49834 | ------------------------------------------------------ | 859 |
| gi\|1198542314\|gb\|NFTR01000008.1\| | ------------------------------------------------------ | 838 |
| emb\|OGNF01009141.1\| | ------------------------------------------------------ | 775 |
| Ga0129306_1000735 | ------------------------------------------------------ | 830 |
| MH0288_GL0082219 | ------------------------------------------------------ | 858 |
| PIG-022_GL0026351 | ------------------------------------------------------ | 753 |
| PIG-028_GL0185479 | ------------------------------------------------------ | 755 |
| 250twins_35838_GL0110300 | P------------------------------------------------RELAQE | 849 |
| PIG-014_GL0226364 | SD-----------------------------------------------RDERKK | 812 |
| 250twins_36050_GL0158985 | YF-----------------------------------------------DKAERK | 872 |
| emb\|OJMM01002900.1\| | V------------------------------------------------DPNERR | 845 |
| emb\|OGPN01002610.1\| | P-------------------------------------------------S-EERK | 870 |
| emb\|OHCP01000044.1\| | P-------------------------------------------------Q-EKRK | 856 |
| PIG-046_GL0077813 | P-------------------------------------------------K-EERK | 858 |
| pig_chimera | P-------------------------------------------------K-EERK | 862 |
| emb\|OIEN01002196.1\| | --------------------------------------------------EA | 789 |
| O2.UC29-0_GL0096317 | --------------------------------------------------ER | 783 |

FIG. 18BBB

| | | |
|---|---|---|
| CasR_Anaerobic_dig | ------------------------------------------- | 811 |
| emb\|OGDF01008514.1\| | ------------------------------------------- | 795 |
| emb\|OGZC01000639.1 | -------------------------------------RKD----------TR | 829 |
| Ga0224415_10048792_chimera | AQASI-----------QALETANPKLYAKYMNYSDEEKKEEFK----------KQ | 811 |
| emb\|OCVV01288914.1\| | AKKSL-----------EELKTTNSKLYENYIKYSDERKAEEAK----------RQ | 813 |
| Ga0187910_10006931 | ALASF-----------DALEKENPELYEKYNMYSEKQKEAELE----------KQ | 824 |
| R._flav_XPD_ | AKESI-----------DSLESANPKLYANYIKYSDEKKAEEFT----------RQ | 819 |
| Ga0224415_10007274 | AKASF-----------AALETANPKLYATYINYSDEEKNAELR----------KQ | 798 |
| Ga0187911_10069260 | ------------------------------------------- | 764 |
| Ga0187910_10015336 | RRSNKDVIETFGDFKGKVSKVVEKKNQGLTNEIYDSLCNVAGTTKTEVQNEIKSILKSNG | 925 |
| ODAI_chimera | ------------------------------------------- | 855 |
| 31009_GL0034153 | ------------------------------------------- | 761 |
| DLF014_GL0011914_ | ------------------------------------------- | 821 |
| CasR_R._albus | ------------------------------------------- | 803 |
| Ga0187910_10040531 | ------------------------------------------- | 797 |
| tpg\|DJXD01000002.1\| | ---------------------------------EF-------- | 740 |
| CasR_E._siraeum | ------------------------------------------- | 811 |
| PIG-018_GL0023397 | ----------------------------------DC-------- | 806 |
| PIG-025_GL0099734 | ------------------------------------------- | 814 |
| Ga0129317_1008067_chimera | ------------------------------------------- | 725 |
| EYZ-362B_GL0088915 | ------------------------------------------- | 787 |
| uncultured_Ru_sp | ------------------------------------------- | 791 |
| R._flav._FD-1 | ------------------------------------------- | 789 |
| tpg\|DBYI01000091.1\| | -----------------------------------NI------- | 803 |

FIG. 18CCC

| | | |
|---|---|---|
| 037___emb\|OIZA01000315.1\| | ----------------------------------------------------ET--KNLKLPKEKDRDIMKKYLPNDKDREEYNKFFKQYRN | 841 |
| emb\|OCTW011587266.1\| | ---------------NKGFLEDFEALWNSC--GKTSRLKEDVLLYARYISPDHALKNYKMILNSYRN | 807 |
| k87_11092736 | WAQYATKRDENMAKHPQKWYDILASHYDELLAL------------------------QATGWLATQARN | 889 |
| BMZ-11B_GL0037915 | ---------------RRKHYPKRRWLNILKDNLAEMERI-----------------DPTGMLAAQMRN | 832 |
| BMZ-11B_GL0037771 | ---------------RKTKRHFSKQWREWLNEKIADAKSS-----------------QATGLLLREARN | 821 |
| BMZ-11B_GL0069617 | ---------------SIRRHFTKKWRDIFRKEIDEAVKI-----------------HFTGYLGWARN | 814 |
| Ga0099364_10024192 | ---------------IRSQRHFSQYWLDIFARQIENAKKT-----------------SESGYLLTAARN | 936 |
| 530373_GL0023589 | ---------------NDFINETKLSKRVCALVNKNRTL-------------------CTNRTYQVYRN | 838 |
| emb\|ODAI011611274.1\| | ---------------RIGENKRANRHGLNCVLENRRNALGS--D------------PASTDAAASLIWSYRN | 893 |
| EMG_10003641 | ---------------LNSYSCRYLTHNISQLD-------------------------RCNDFIRQYRN | 947 |
| CasR_P1E0_metageno | ---------------LNRHACGYLRSNMNG---------------------------ISNSLLTAYRN | 801 |
| emb\|OIZX010000427.1\| | ---------------LKRSACEQIQHNMEN---------------------------ISDRLLREYRN | 837 |
| 160582958_gene49834 | --KQETGTGAHTKKRIEKLNQQIAYIDKDIKN-------------------------MHSYTCRNYRN | 898 |
| gi\|1119854231\|gb\|NFIR01000008.1\|: | ---------------PKKKVKDYLAKNFEY---------------------------SNKWSLKEFRN | 864 |
| emb\|OGNF010091141.1 | ---------------INPRASAYLTVNLAN---------------------------SDETAIRTFRN | 801 |
| Ga0129306_1000735 | --LVRTLRREKRVCDNLHNNYAYLCGAD----------------------------AEPGDASLSLLFVYRN | 872 |
| MR0288_GL0082219 | ---------------LNRRAAKYLQTNLEH---------------------------SDNTLIRQYRN | 884 |
| PIG-022_GL0026351 | ---------------LNPHASRYLKVNISN---------------------------ADEWSIVKFRN | 779 |
| PIG-028_GL0185479 | ---------------LNSHARNYLRVNISN---------------------------SDEWSIVKFRN | 781 |
| 250twins_35838_GL0110300 | RFAQIKRRESGCYFKSYHVYDYLSKNSNEFKQ-------------------------NHIDFAVTSYRN | 893 |
| PIG-014_GL0226364 | QHRENDKYYDSCMHFSRHSFEYISKNFAEVQSH------------------------PDPLKLFIKYRN | 857 |
| 250twins_36050_GL0158985 | KVLRQNDKMIRKMHFTPHSLNYVQKNLESVQS-------------------------NGLAAVIKEYRN | 916 |

FIG. 18DDD

```
emb|OJMM01002900.1|        LAVRANDKVVKHTHFNLHSYKYVKHNYEEISK--------------------------------ASKIITAYRN  887
emb|OGPN01002610.1|        PLRKANDKLLKQTHYTNHSYTYIVNNLNSFTDIDYCAKDVGLPAPNDKNDNASILGEMRN            930
emb|OHCP01000044.1|        ELRKENDQLLKKTHYSKHAYCYIVDNVNNLIGAVANDNGRGLPCLSEKNDNANLFLEMRN            916
PIG-046_GL0077813          AMRKVNDQLLKQIHFSKHSYCYIVDNVNRLIGGECRTDKRVLPVLNEKNDNAGILSDFRK            918
pig_chimera                AMRKVNDQLLKRTHFSKHSYCYIVDNVNRLTGGECRTDKRVLPVLNEKNDNAGILDFRK             922
emb|OIEN01002196.1|        IKKNVLKYNGMPESLNHIPGEYICKNMEGYHEN-------------------------------TVRNFRN  829
O2.UC29-0_GL0096317        IKENIKKYGGDPKSIDHIPGEYIKKNLEGYCAG-------------------------------STNTFRN  823
CasR_Anaerobic_dig         ---------LPVRKAEILRANLKHLDCED----------------------------------GFKYYRN  838
emb|OGDF01008514.1|        --------NPKKPTVKSIKEQYAFLIPY-----------------------------------IFITYRN  822
emb|OGZC01000639.1         TVVEKAEAAKNRHLKNVKWNCKTRENLENA---------------------------------DKNAIVAFRN  869
Ga0224415_10048792_chimera LNRERVKNARNAYLKNIKNYIMIRLQLRDQTDS------------------------------SGYLCGEFRD  854
emb|OCVV01288914 4.1|      INREREKTAMNAHLRNTKWNDIMYGQLKDLADS------------------------------KSRICSEFRN  856
Ga0187910_10006931         INREKAKTALNAHLRNTKWNVIIRENIRNT---------------------------------EKDACKQFRN  864
R._flav_XPD                INREKAKTALNAYLRNTKWNVIIREDLLRI---------------------------------DNKTCTLFRN  859
Ga0224415_10007274         INREKAKTALNAHLRNTKWNVIIREDLLRR---------------------------------DNKACKIFRN  838
Ga0187911_10069260         ----------YLKKRPVEYLKKDMAMVGNS---------------------------------SIRHFRN    791
Ga0187910_10015336         LDESASSYLSHKLVNKVHSYKYLKQNLDCADNT------------------------------MINQFRN   965
ODAl_chimera               ---TDSKSQQKAKSRRRWCLLLKEDIDKLNGC-------------------------------ESLRILYRN  894
31009_GL0034153            ---------YTSKKNQYIQKNMKIYSKI-----------------------------------NKNFNVFVRJRN  792
DLF014_GL0011914_          KKKNKKYGEYTSKKISTYIETNMKNFIGCE---------QFRTPERYRDTQIDMFVKYRN             871
CasR_R._albus              ---------GKLGCNKKVGRYLKNNISCCTDG-------------------------------LINTYRN   833
Ga0187910_10040531         ------GH--FKNKKWRGIAEQNLRNSDVP---------------------------------VIKSFRN   826
tpg|DJXD01000002.1|        --------GHLKNQKGHRKWYVLVKNMLQNSDII-----------------------------AVSSFRN   773
CasR_E._siraeum            DKSF-AENAANRYLRNARWYKLILDNLKKSERA------------------------------VVNEFRN   850
```

FIG. 18EEE

| | | | |
|---|---|---|---|---|
| PIG-018_GL0023397 | DLGR-AETAANRHLRKKRWYVQIFNNLKQADRN | ------------------- | ----------VINEFRN | 845 |
| PIG-025_GL0099734 | -------NLHLRSKKWNRLMRVNLENYSAA | ------------------- | ----------ASQNFRN | 844 |
| Ga0129317_1008067_chimera | -------HFISHNRRMRDCIEENVKNSEQLI | ------------------- | -------FGKEDAVIRFRN | 761 |
| EYZ-362B_GL0088915 | -------KGYLARNKRLCQCVREDIDNAKHL | ------------------- | ----------NGDITDYRN | 820 |
| uncultured_Ru_sp | -------LFLKKNERLRKCVEVDINNADSS | ------------------- | ----------MTRKYRN | 821 |
| R._flav._FD-1 | -------RYLAGNKRLRDCVKQDIDNAKKWE | ------------------- | ----------VSDKYNSITKYRN | 826 |
| tpg:DBYI01000091.1: | NQDKVQMPKNYFLARNKRWREALEQDIDNAKKWF | ------------------- | -------IGEKFNNVKNYRN | 850 |
| | | * . | * . | |
| 037___embl:OIZA01000315.1: | NIVHLKIIA-KLSEL----TKNIDK | -------DINSYFDIYHYCTQRVMFDYCKKNN | | 886 |
| embl:OCTW011587266.1: | KIAHLNVIM-SAGKY----TGGIK | -------RMDSYFSVFQHLVQCDILSNPNNKG | | 851 |
| k87_11092736 | DAEHLNPVN-EFDVY----IEDLRRYPEGTPKNKDYHIGSYFEIYHYIRQRAYLEEVLAKR | | | 945 |
| BMZ-11B_GL0037915 | DAMHLNAMF-KIAKF----VGDFRK-----G---SSHEMRSYFELFHFLEQKTLLDSKEDFV | | | 881 |
| BMZ-11B_GL0037771 | DVEHLNVLR-AIPDY----IQDFRH-----GEKG---ETAMNSYFELYHYLMQRLMKNTELDL | | | 872 |
| BMZ-11B_GL0069617 | QSAHLNVLTQALPQF----IGQFAR-----NSKTGKTARMTSYFQLYHYLLQRLLCEDLNFDV | | | 868 |
| Ga0099364_10024192 | CALHLNVLT-ALPEF----VGEFRK-----T---GDKMTSYFELYHFLLQKLMLAEAGLNL | | | 984 |
| 530373_GL0023589 | LIMHLNAVS-AFPQY----LEGLK | -------VVHSYFDLYHYTVMMLLHRQNEKE- | | 881 |
| embl:ODAI011611274.1: | AAAHLTAVA-AAQEY----VSELR | -------EIHSYFEVYHYAMQRYLKSGAEFA- | | 936 |
| EMG_10003641 | KVAHLEVVS-NIDEY----LSGIK | -------HIESYYALYHYLMQKCLLKNYRIE- | | 990 |
| CasR_P1E0_metageno | AVDHLNAIP-PLGSL----CRDIG | -------RVDSYFALYHYAVQQYLNGRYYRK- | | 844 |
| embl:OIZX01000427.1: | AVAHLNVIA-HLADY----SADMR | -------EITSYYGLYHYLMQRHLFKRHAWQI | | 881 |
| 160582958_gene49834 | LVAHLNVVS-KLQNYVSELPNDY | -------QITSYFSFYHYCMQLGLMEKVSSK- | | 944 |
| gi|119854231|gb:NFIR01000008.1: | SVQHLNVIR-DAHKYIKYINDNK | -------DVQSYFALYHYLVQRYISERAANRT | | 911 |
| embl:OGNF01009141.1 | TAEHLEALR-NADKY----LNDLK | -------QFDSYFEIYHYITQRNIKEKCEML-- | | 844 |

FIG. 18FFF

| | | |
|---|---|---|
| Ga0129306_1000735 | KAAHLSVLN-KGGRL----SGDLK---------------EAKSWFYVYHFLMQRVLEEFRNT- | 915 |
| MH0288_GL0082219 | SVAHLNAVR-NMNLY----IGDLR---------------EITSYFGIYHYIMQRDLITRCQKV- | 927 |
| PIG-022_GL0026351 | GTAHLNSVR-NIDTC----IEGLK---------------DFKSYFEIYAYTVQKSIKKYFDAEF | 823 |
| PIG-028_GL0185479 | GVAHLNSVR-NIDTS----IKGLR---------------EFKSYFEIYAYTVQKSIKNYYDAES | 825 |
| 250twins_35838_GL0110300 | NVEHLNVVH-CMTKY----FSEVK---------------DVKSYYGVYCYIMQRMLCDELIIKN | 937 |
| PIG-014_GL0226364 | NVMHLNIIR-DLNDY----LPDFKR----G-----KAFEKTDFYDLYCYCLQRMLLSEVD---- | 904 |
| 250twins_36050_GL0158985 | AVAHLNIIN-RLDEY----IGSAR-----------ADSYYSLYCYCLQMYLSKNFSVG------ | 958 |
| embl0JMM01002900.1| | NVQHLNVMN-SITKY----LGDIS---------------EVTSYYSLYCYTLQRLLLDDNNND- | 930 |
| embl0GPN01002610.1| | DIAHLNIVH-DMVKY----IEELK---------------DISSYYAFYCYVLQRRLVGKDPNC- | 973 |
| embl0HCP01000044.1| | KIVHLNVVH-DMVKY----INEIK---------------NITSYYAFFCYVLQRMIGNNSNE-- | 959 |
| PIG-046_GL0077813 | TIAHLNVVH-KMVDY----VAEIK---------------GITSYYAFFCYVLQRMPVGNKN--E | 960 |
| pig_chimera | TIAHLNVVH-KMVDY----VDEIK---------------GITSYYAFFCYVLQRMLVGNNLNE- | 965 |
| embl0IEN01002196.1| | MVAHLTAVA-RVPLY----ISEVT---------------QIDSYYALYHYCMQMNILQGIEQSG | 873 |
| 02.UC29-0_GL0096317 | AVAHLALMA-RVSEY----ASDIK---------------NVNSYFSLYHYCMQKHILLYCARRFN | 867 |
| CasR_Anaerobic_dig | QVTHLNAIR-VAYKY----INEIK---------------SVHSYFALYHYIMQRHLYDSLQAKA | 882 |
| embl0GDF01008514.1| | MIAHLAAVT-NAYKY----IPQMD---------------RFKSWFHLYHTVIQHSLIQQYEYDR | 866 |
| embl0GZC01000639.1 | IVAHLWIIR-DADRF----ITGMG---------------AMKRYFDCYHYLLQRELGYILEKSN | 913 |
| Ga0224415_10048792_chimera | KVAHLEVAR-HAHEY----IGNIK---------------EVNSYFQLYHYIMQCRLYDVLKNNT | 898 |
| embl0CVV012889144.1| | KAAHLEVAR-YAHMY----INDIS---------------EVKSYFRLYHYIMQRRIIDVIENNP | 900 |
| Ga0187910_10006931 | KADHLEVAR-YAYKY----INDIS---------------EVNSYFQLYHYIMQRIIIDSSGN-- | 906 |
| R._flav_XPD_ | KAVHLEVAR-YVHAY----INDIA---------------EVNSYFQLYHYIMQRIIMNERYE-- | 901 |
| Ga0224415_10007274 | KVAHLEAIR-YAHLY----INDIA---------------EVNSYFQFYHYIMQRRIMAERYD-- | 880 |
| Ga0187911_10069260 | ATVHLNVIM-EAHRY----TKDIK---------------YIGSYYALYHYILQRHLLDKIEEDS | 835 |
| Ga0187910_10015336 | NVAHLNTIR-NMDG-----IENVT---------------GITSYFQIYHYLMQKALYKEFKKCR | 1008 |

FIG. 18GGG

```
ODAI_chimera                   AVAHLNIPR-NAIDY---IGGIK----------KADSYFAIYHYMMQQYLSKKHGLP-  937
31009_GL0034153                NIAHLNSIK-NATKY---VNDIG----------IFTSYFQLYHYIMQCDLKDWVKKEV  836
DLF014_GL0011914_              SIAHLNAVR-KASKY---INDIR----------GFDTYFELYHYIMQRDLKDILEKIA  915
CasR_R._albus                  QVDHFAVVR-KIGNY---AAYIK----------SIGSWFELYHYVIQRIVFDEYRFAL  877
Ga0187910_10040531             MAAHISVIR-NIDLY---IGDIQ----------KVDSYFALYHFLMQKLIQRVVPENT  870
tpg|DJXD01000002.1|            IVAHISVVR-NSNEY---ISGIG----------ELHSYFELYHYLVQSMIAKNNWYDT  817
CasR_E._siraeum                TVCHLNAIR-NININ---IKEIK----------EVENYFALYHYLIQKHLENRFADKK  894
PIG-018_GL0023397              SVCHLNAIR-NINTN---IEGIG----------FVKNYFALYHYLIQRHISSKRIS--  887
PIG-025_GL0099734              AVAHLNPIR-NADVL---IEGIE----------NITSYFDIYHYIVQRSVLNRTNKT-  887
Ga0129317_1008067_chimera      NVAHLSAIR-NANEY---IGDIR----------EITSYFALYHLMQRKLIDDCKVN--  804
EYZ-362B_GL0088915             CVAHLNVVR-NCDQY---LENID----------TVHSYFSLYQYLVQHYLLKRFEKDK  864
uncultured_Ru_sp               CIAHLTVVR-ELKEY---IGDIC----------TVDSYFSIYHYVMQRCITKRENDTK  865
R._flav._FD-1                  NVAHLTAVR-NCAEF---IGDIT----------KIDSYFALYHYLIQRQLAKGLDHER  870
tpg|DBYI01000091.1|            NVAHLTAIR-NCAEF---IGEIT----------KIDSYFALYHYLIQRQLAGRLDPNH  894
                                *:                               ::  *:

037---emb|OIZA01000315.1|      NVVLA----------------------KMKDLAHIKSDCDEFSSKHTYPYSSAVLRFM  922
emb|OCTW011587266.1|           KCFES----------------------ESL--KPLLL-DMKFDGTDEKLYSKRLITRAL  884
k87_11092736                   KEYRD----------------------SGSFTDEQLDK-LQKILDDIRARGSYDKNLLKLE  983
BMZ-11B_GL0037915              QGMRE----------------------S-----------------YGDRIRVEPCVDLIKYL  904
BMZ-11B_GL0037771              S-HWS----------------------G-----------------WIMRSGRPDRDLIQIA  893
BMZ-11B_GL0069617              PEEWK----------------------N-----------------KIQETGLPCNDLIHIC  890
Ga0099364_10024192             D-EYR----------------------E-----------------RIDTYQTACKDLINIT  1005
530373_GL0023589               ---------KKRNEKEKKQNEKENNMILSTA-ALEKYDMVRKYQSANKDFIYAI  925
```

FIG. 18HHH

```
emb|ODAI011611274.1|            ------------------------------ELVSKNGPASGK--IAAWANAVDRCHSFCKDWLWLL  970
EMG_10003641                    ------------------------------DHSQNEYKN--LNDFSSKLDKHGTYVKDFVKAL  1021
CasR_PIE0_metageno              ------------------------------TPR--EQELFAAMAQHRTWCSDLVKAL       869
emb|OIZX01000427.1|             RQPERP------------------------TEEEQKLIEQEQKQLAW--EKALFDKTLQYHSYNKDLVKAL  926
160582958_gene49834             ------------------------------NIPLVESLKNEANDAQSYSAKK--TLEYFDLIEKNRTYCKDFLKAL  988
gi|1119854231|gb|NFTR010000008.1| ----------------------------DKESLSEGR--LQYYLSQVKEYRTYCKDFVKAL  942
emb|OGNF01009141.1|             ------------------------------KEQ--TVKYNNDLLKYHGYSKDFVKAL      869
GaO129306_1000735               ------------------------------QALPER--LRELLMMAERYRGCSKDLIKVL   943
MH0288_GL0082219                ------------------------------KMKNPV--VVGYFDKVRTYRTCCKDLVKAL   955
PIG-022_GL0026351               SEDRNIEDGKISLCNGVYIHERQKNGKPKITVKINPK--TIEYMESVDKYGSYTKDFVKAL   882
PIG-028_GL0185479               P-----------------------------VQINPK--TIEYMESVDKYGSYTKDFVKAL   854
250twins_35838_GL0110300        QDKPD-------------------------VRQT--FEEYNRLLKDHGTYSKNLMWLL     968
PIG-014_GL0226364               ------------------------------G--FSAINENIDKYCTASKDFMNLL        927
250twins_36050_GL0158985        ------------------------------Y--LINVQKQLEEHHTYMKDLMWLL        981
emb|OJMW01002900.1|             ------------------------------K--FASIKGNLRKFGIYNKDFMWLL        953
emb|OGPN01002610.1|             ------------------------------QNKF--KAKYAKELNDYGTYNKNLMWML     999
emb|OHCP01000044.1|             ------------------------------QNKF--KAKYSKTLQEFGTYSKDLMWVL     985
PIG-046_GL0077813               ------------------------------KNAL--KEKYSETAKSYGTYSKDFMWLI     986
pig_chimera                     ------------------------------KNAI--KEKYSATVKSFGTYSKDFMWLI     991
emb|OIEN01002196.1|             RIL-------------------------DNIK--LKNALENARVHRTYSKDAVKYL       902
O2.UC29-0_GL0096317             KQ--------------------------GNEK--MAAALNDAEIHRSYSKDAVKFL       895
CasR_Anaerobic_dig              KDS-------------------------SGF--VIDALKKSFEHKIYSKDLLHVL        910
emb|OGDF01008514.1|             DYGRK-----------------------GAPVVSER--VLQLLEQCREHSNYSRDLLHIL   901
emb|OGZC01000639.1|             ---Q----------------------GSEY--TKKSLEKVQQYHSYCKDFLHML         940
```

FIG. 18III

| | | |
|---|---|---|
| Ga0224415_10048792_chimera | KAEAM----------------------------VKGK--AKEYFEALEKEGTYNDKLLKIA | 929 |
| emb¦OCVV01288914¦.1¦ | K--AK----------------------------YEGK--VKVYFEDVKKNKKYNKNLLKLM | 929 |
| Ga0187910_10006931 | ----N----------------------------ANGM--IKKYYESVISDKKYNDRLLKLL | 933 |
| R._flav._XPD_ | ----K----------------------------SSGK--VSEYFDAVNDERKKYNDRLLKLL | 928 |
| Ga0224415_10007274 | ----K----------------------------SSGK--VREYFDAVNNEKKYNDRLLKLL | 907 |
| Ga0187911_10069260 | YAEKT----------------------------VS--EKLWESQISQYGTYSKDFVKAL | 864 |
| Ga0187910_10015336 | ENAVRKWIPYITENAEPKYVYWNKKEQQEVEVSFNPKIFGYMENIKNHSNTYCKDFVKAL | 1068 |
| ODAI_chimera | ---------------------------------EGLGCTHGVYCKDLVKAL | 955 |
| 31009_GL0034153 | EEKKI----------------------------SDKY--YNYLEKYYKNMNIYLKDFVKAI | 867 |
| DLF014_GL0011914_ | EGAAKET--------------------------EEGQKQDEL--LKTYFDMLDKYGTYVKDFVKAL | 953 |
| CasR_R._albus | ----N----------------------------NT--ESNYKNSIIKHHTYCKDMVKAL | 902 |
| Ga0187910_10040531 | KGL------------------------------SDQ--TKKYYDALEQYNTYCKDFVKAY | 898 |
| tpg¦DJXD01000002.1¦ | S--H-----------------------------QPK--TAEYLNNLKKHHTYCKDFVKAY | 844 |
| CasR_E._siraeum | VE-------------------------------RD--TGDFISKLEEHKTYCKDFVKAY | 920 |
| PIG-018_GL0023397 | FN-------------------------------SF--SAEYISNLEKYHTPSEYFIKAY | 913 |
| PIG-025_GL0099734 | ---------------------------------PK--MKEYEELINKYHTYNKDFVKAL | 911 |
| Ga0129317_1008067_chimera | ---------------------------------DT--AHKYFEQLIKYKTYVMDMVKAL | 828 |
| EYZ-362B_GL0088915 | YRCK-----------------------------DDL--AIHYYSQVKQYRSYVKDLVKAL | 893 |
| uncultured_Ru_sp | QEE------------------------------KIKYEDDLLKNHGYTKDFVKAL | 890 |
| R._flav._FD-1 | SGF------------------------------DR--NYPQYAPLFKWHTYVKDVVKAL | 897 |
| tpg¦DBYI01000091.1¦ | PGF------------------------------EK--NYPQYAPLFKWNTYVKDMVKAL | 921 |
| | | |
| 037_--_emb¦OIZA01000315.1¦ | NLPFAYNVPRFKNLSYKKFFDKQ---------- | 945 |

FIG. 18JJ

| | | |
|---|---|---|
| emb\|OCTW011587266.1\| | NIPFGYNLPRYKNLTFEKIYLKSSINE------------------------------ | 911 |
| k87_11092736 | YLPFAYNLPRYKNLTTEALFDDDSVSGKKRVAEWREREKTREAEREQRRQR------ | 1034 |
| BMZ-11B_GL0037915 | YITLGYSLPRYKIMTVSGLFDPDSEDAKERAKGKRA---------------------- | 940 |
| BMZ-11B_GL0037771 | FVSLAYNLPRYRNLIKEHHFDDTVLQKIREKESLD----------------------- | 928 |
| BMZ-11B_GL0069617 | FVPLGYNLPRYKNLTIECLFDEDSVSAKEGKKA------------------------- | 923 |
| Ga0099364_10024192 | YVSLGYNLPRYKNLTCEPLFDEESATGKERQTRLDEKSKEKKQRKGGQK--------- | 1054 |
| 530373_GL0023589 | NSPLAYNAARYINLSCRTKFEEGFGK-------------------------------- | 951 |
| emb\|ODAI011611274.1\| | NVPFAYNPARYKNLSIANLFDKNEAAPVTEDASEQKEDE------------------- | 1009 |
| EMG_10003641 | NVPFGYNLPRYKNLSIDELFDRNKLKTGGTIEMKGE---------------------- | 1057 |
| CasR_P1E0_metageno | NTPFGYNLARYKNLSIDGLFDREGDHVVREDGEKPAE--------------------- | 906 |
| emb\|OIZX01000427.1\| | NAPFGYNLARYKNLSIEPLFSKEAAPAAEIKATHA----------------------- | 961 |
| 160582958_gene49834 | NAPFSYNLPRFKNLSIEALFDKNIVYEQADLKKE------------------------ | 1022 |
| gi\|1119854234\|gb\|NFIR01000608.1\| | NVPFAYNLPRYKNLSIDELFDRNNYLPNKAKKWIPEKKENGEYVMEDCGNKDAGQVENA | 1001 |
| emb\|OGNF01009141.1\| | CVPFGYNLPRFKNLSIDALFDKNDKREKLRKGFED----------------------- | 904 |
| Ga0129306_1000735 | NLTFAYNLPRYKNLSIDGRFEDKNRPGDKKESALIAE---------------------- | 973 |
| MH0288_GL0082219 | NITFGYNLPRYKNLSIEGLFDKNRPGDKKESALIAE---------------------- | 991 |
| PIG-022_GL0026351 | NTPFGYCLARYKNLSIEPLFDRNTVYMKEDVTEEFSVNSKEQ---------------- | 924 |
| PIG-028_GL0185479 | NTPFGYCLARYKNLSIEPLFDRNTVYNKKDVKEEFAVNSK------------------ | 894 |
| 250twins_35838_GL0110300 | NFPFAYNLARYKNLSNEDLFMARNNDQKSK---------------------------- | 998 |
| PIG-014_GL0226364 | NIIFAYNVPRYKNLSNKELFYRLDSEQ------------------------------- | 954 |
| 250twins_36050_GL0158985 | NIPFAYNLARYKNLSNEKLFYDEEAAEKADKAENERGE-------------------- | 1020 |
| emb\|CJMM01002900.1\| | NIPFAYNLPRYKNLSNEEIFYDELQK-------------------------------- | 979 |
| emb\|OGPN01002610.1\| | NLPFAYNLPRYKNLSSEFLFYDMEYNKKDDE---------------------------- | 1030 |
| emb\|OHCP01000044.1\| | NLPFAYNLPRYKNLSNEQLFYDEEERMEKIVGRKNDSR-------------------- | 1023 |

FIG. 18KKK

| | | |
|---|---|---|
| PIG-046_GL0077813 | NLPFAYNLPRYKNLSNEQLFYDEERNETEGQIDRL | 1022 |
| pig_chimera | NLPFAYNLPRYKNLSNEQLFYDEERNETEEQIDRL | 1027 |
| emb\|OIEN01002196.1\| | CLPFAYNISRYKALTIKDLFDWTEYSCKKDE | 933 |
| O2.UC29-0_GL0096317 | CLPFAYNLPRYKALTVEGLFDWNEYGQDDD | 925 |
| CasR_Anaerobic_dig | HSPFGYNTARYKNLSIEALFDKNESRPEVNPLSTND | 946 |
| emb\|OGDF01008514.1\| | NLPFGYNLPRYLNLSSEKYFDANAI | 926 |
| emb\|OGZC01000639.1 | CLPFAYCIPRYKNLSIAELFDRHEPEAEPKEEASSVNNSQFITT | 984 |
| Ga0224415_10048792_chimera | CVPFGYCIPRYKNLSMEELFDMNEEKKFKKKAPENT | 965 |
| emb\|OCVV012889144.1\| | CVPFGYCIPRFKNLSIEQMFDMNETDNSDKKKEK | 963 |
| Ga0187910_10006931 | CVPFGYCIPRFKNLSIEALFDKNEAAKYDKIKKVAVR | 971 |
| R._flav_XPD_ | CVPFGYCIPRFKNLSIEALFDRNEAAKFDKEKKKVSGNS | 967 |
| Ga0224415_10007274 | CVPFGYCIPRFKNLSIEALFDMNEAVKFDKEKK | 940 |
| Ga0187911_10069260 | CCPFGYNLPRFKNLSIDELFDRNESKEITDATAPRQ | 900 |
| Ga0187910_10015336 | CAPFAYNLPRFKNLSIEELFDMHELSEEPKESMKLTD | 1105 |
| ODAI_chimera | NAPFGYNLPRFKNLSVEALFDMNEEPAPEGKERSKNADGCN | 996 |
| 31009_GL0034153 | NVPFAYNYSRFKNLSIDKLFDKNDPRKKWVIFNF | 903 |
| DLF014_GL0011914_ | NIPFAYNYPRYKNLSIDELFDKNNTRKTIKIQDKKLEERT | 993 |
| CasR_R._albus | NTPFGYDLPRYKNLSIGDLFDRNNYLNKTKESIDANSSIDSQ | 944 |
| Ga0187910_10040531 | CTPFAYVTPRYKNLTIDGLFDRNKPGEDK | 927 |
| tpg\|DJXD01000002.1\| | CIPFGYVVPRYKNLTINELFDRNNPNPEPKEEV | 877 |
| CasR_E._siraeum | CTPFGYNLVRYKNLTIDGLFDKNYPGKDDSDEQK | 954 |
| PIG-018_GL0023397 | CTPFAYNLVRYKNLTIDGLFDRNAPSEK | 941 |
| PIG-025_GL0099734 | CAPFGYNVVRFKALTIYEMFDRNYPEEKRAEEARKSC | 948 |
| Ga0129317_1008067_chimera | CSPFGYNLPRFKNLSIEGKFDMHESK | 854 |

FIG. 18LL

| | | |
|---|---|---|
| EYZ-362B_GL0088915 | NAPFGYNIPRFKNLTVEQLFDRNADPETITA------------------------------ | 924 |
| uncultured_Ru_sp | NSPFGYNIPRFKNLSIEQLFDRNEYLTEK-------------------------------- | 919 |
| R._flav._FD-1 | NAPFGYNIPRFKNLSIDALFDRNEIKKNDGEKKSDD------------------------- | 933 |
| tpg\|DBYI01000091.1\| | NSPFGYNIPRFKDLSIDALFDRNEMKEETDDEKKIQT------------------------ | 958 |
| | :.*  *:  ::  : | |

FIG. 18MMM

RNA TARGETING METHODS AND COMPOSITIONS

CROSS-REFERENCE TO RELATED APPLICATIONS

This application claims priority to U.S. Provisional Application No. 62/548,846 filed Aug. 22, 2017, U.S. Provisional Application No. 62/572,963 filed Oct. 15, 2017, and U.S. Provisional Application No. 62/639,178, filed Mar. 6, 2018, all of which are herein incorporated by reference in their entireties.

ACKNOWLEDGMENT OF GOVERNMENT SUPPORT

This invention was made with government support under 5 DP5 OD021369-02 and 5 R21 AG056811-02 awarded by The National Institutes of Health. The government has certain rights in the invention.

FIELD

This disclosure relates to a CRISPR/Cas system for modifying (including detecting) RNA, which utilizes novel Cas13d proteins (also referred to a CasR and nCas1) and guide RNAs.

BACKGROUND

Mapping of transcriptome changes in cellular function and disease has been transformed by technological advances over the last two decades, from microarrays (Schena et al., 1995) to next-generation sequencing and single cell studies (Shendure et al., 2017). However, interrogating the function of individual transcript dynamics and establishing causal linkages between observed transcriptional changes and cellular phenotype requires the ability to actively control or modulate desired transcripts.

DNA engineering technologies such as CRISPR-Cas9 (Doudna and Charpentier, 2014; Hsu et al., 2014) enable researchers to dissect the function of specific genetic elements or correct disease-causing mutations. However, simple and scalable tools to study and manipulate RNA lag significantly behind their DNA counterparts. Existing RNA interference technologies, which enable cleavage or inhibition of desired transcripts, have significant off-target effects and remain challenging engineering targets due to their key role in endogenous processes (Birmingham et al., 2006; Jackson et al., 2003). As a result, methods for studying the functional role of RNAs directly have remained limited.

One of the key restrictions in RNA engineering has been the lack of RNA-binding domains that can be easily retargeted and introduced into target cells. The MS2 RNA-binding domain, for example, recognizes an invariant 21-nucleotide (nt) RNA sequence (Peabody, 1993), therefore requiring genomic modification to tag a desired transcript. Pumilio homology domains possess modular repeats with each protein module recognizing a separate RNA base, but they can only be targeted to short 8 nt RNA sequences (Cheong and Hall, 2006). While previously characterized type II (Batra et al., 2017; O'Connell et al., 2014) and VI (Abudayyeh et al., 2016; East-Seletsky et al., 2016) CRISPR-Cas systems can be reprogrammed to recognize 20-30 nt RNAs, their large size (~1200 amino acids, aa) makes it difficult to package into AAV for primary cell and in vivo delivery.

SUMMARY

This application provides bioinformatic analysis of prokaryotic genomes to identify sequence signatures of CRISPR-Cas repeat arrays and mine previously uncharacterized, compact Cas ribonucleases that can be used for RNA targeting tools. Engineered Type VI-D CRISPR effectors can be used to efficiently knockdown endogenous RNAs in human cells and manipulate alternative splicing, paving the way for RNA targeting applications and further effector domain fusions as part of a transcriptome engineering toolbox.

Provided herein are methods of modifying one or more target RNA molecules, such as a clustered regularly interspaced short palindromic repeats (CRISPR)-CRISPR associated (Cas) system-mediated RNA editing method. Such methods can include contacting one or more target RNA molecules with a non-naturally occurring (e.g., does not naturally occur in the cell or system into which it is introduced) or engineered CRISPR-Cas system. Such a CRISPR-Cas system can include (1) at least one Cas13d protein or at least one Cas13d nucleic acid coding sequence (such as a mRNA or a vector encoding the at least one Cas13d protein) and (2) at least one CRISPR-Cas system guide nucleic acid molecule (such as a guide RNA, gRNA) that hybridizes with the one or more target RNA molecules, or at least one nucleic acid molecule encoding the gRNA. The Cas13d protein forms a complex with the gRNA, and the gRNA directs the complex to the one or more target RNA molecules and modifies (e.g., cuts, detects) the one or more target RNA molecules. In some examples, the one or more target RNA molecules (or a cell containing the one or more target RNA molecules) are contacted with a complex including the at least one Cas13d protein and the at least one gRNA. In some examples, the system includes $Mg^{2+}$. However, in some example, the system does not include $Mg^{2+}$, such as if cleavage of the target RNA is not desired.

In some examples, contacting the one or more target RNA molecules with the non-naturally occurring or engineered CRISPR-Cas system includes introducing into a cell (such as a eukaryotic or prokaryotic cell) containing the one or more target RNA molecules the non-naturally occurring or engineered CRISPR-Cas system, for example using endocytosis, a liposome, a particle, an exosome, a microvesicle, a gene gun, electroporation, a virus, or combinations thereof. In some examples, contacting the one or more target RNA molecules with the non-naturally occurring or engineered CRISPR-Cas system includes contacting a cell-free system (such as a biological or environmental sample, or a cell lysate) containing the one or more target RNA molecules with the non-naturally occurring or engineered CRISPR-Cas system (for example in a diagnostic method to detect a target RNA).

In some examples, the least one Cas13d protein includes one or more HEPN domains, is no more than 150 kD, no more than 140 kD, no more than 130 kD, no more than 120 kD, such as about 90 to 120 kD, about 100 to 120 kD or about 110 kD; includes one or more mutated HEPN domains, and can process the guide RNA, but cannot cleave or cut the one or more target RNA molecules, includes an Cas13d ortholog from a prokaryotic genome or metagenome, gut metagenome, an activated sludge metagenome, an anaerobic digester metagenome, a chicken gut metagenome, a human gut metagenome, a pig gut metagenome, a bovine gut metagenome, a sheep gut metagenome, a goat gut metagenome, a capybara gut metagenome, a primate gut metagenome, a termite gut metagenome, a fecal metagenome, a genome from the Order Clostridiales, or the Family Ruminococcaceae; includes an Cas13d ortholog from *Ruminococcus albus*, *Eubacterium siraeum*, a *flavefaciens* strain XPD3002, *Ruminococcus flavefaciens* FD-1, uncultured *Eubacterium* sp TS28-c4095, uncultured *Ruminococcus* sp., *Ruminococcus bicirculans*, or *Ruminococcus* sp CAG57; includes at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253, or combinations thereof. In some examples, the least one Cas13d protein has at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253, and includes at least one motif shown in SEQ ID NO: 195, 196 or 197. In some examples, the least one Cas13d protein further includes one or more other agents (e.g., is a fusion protein), such as one or more subcellular localization signals, one or more effector domains, or combinations thereof. In some examples, the least one Cas13d protein that includes one or more HEPN domains, is no more than 1500 aa, no more than 1200 aa, no more than 1100 aa, no more than 1000 aa, such as about 800 to 1500 aa, about 800 to 1250 aa or about 850 to 950 aa.

Also provided are isolated nucleic acid molecules encoding such Cas13d proteins, such as a cDNA, genomic DNA, RNA, or mRNA. Such isolated nucleic acid molecules can be part of a vector (such as a plasmid or viral vector), and can be operably linked to a promoter. In some examples, an isolated nucleic acid molecule encoding a Cas13d protein has at least 80%, at least 85%, at least 90%, at least 92%, at least 95%, at least 96%, at least 97%, at least 98%, at least 99%, or 100% sequence identity to SEQ ID NO: 124, 125, 126, 127, 128, 139, 140 or 141. In some examples, an isolated nucleic acid molecule encoding at least one Cas13d protein (which can be part of a vector) includes at least one Cas13d protein coding sequence codon optimized for expression in a eukaryotic cell, such as human cell, for example a Cas13d coding sequence having at least 80%, at least 85%, at least 90%, at least 92%, at least 95%, at least 96%, at least 97%, at least 98%, at least 99%, or 100% sequence identity to SEQ ID NO: 114, 115, 116, 117, 118, 119, 120, 121, 122, 123, 142, 143, 144, or 145.

In some examples, the gRNA that hybridizes with the one or more target RNA molecules in an Cas13d-mediated manner includes one or more direct repeat (DR) sequences, one or more spacer sequences, such as one or more sequences comprising an array of DR-spacer-DR-spacer. In some examples, the one or more DR sequences have at least 80%, at least 85%, at least 90%, at least 92%, at least 95%, at least 96%, at least 97%, at least 98%, at least 99%, or 100% sequence identity to SEQ ID NO: 129, 130, 131, 132, 133, 134, 135, 136, 137, 148, 150, 151, 152, 154, 156, 157, 159, 161, 163, 165, 167, 169, 176, 178, 180, 182, 184, 186, 188, 190, 191, 192, 193, 199, 201, 203, 205, 207, 209, 211, 213, 215, 217, 219, 221, 223, 225, 227, 228, 230, 232, 234, 236, 238, 240, 242, 244, 246, 248, 250, 252, or 254. In one example, the gRNA includes additional sequences, such as an aptamer sequence.

In some examples, a plurality of gRNAs are generated from a single array, wherein each gRNA can be different, for example target different RNAs or target multiple regions of a single RNA, or combinations thereof.

Methods of targeting one or more target RNA molecules are provided. In some examples, an entire RNA is targeted. In some examples, a portion of an RNA is targeted. Targeting an RNA molecule can include one or more of cutting or nicking one or more target RNA molecules, activating one or more target RNA molecules, deactivating the one or more target RNA molecules, visualizing or detecting the one or more target RNA molecules, labeling the one or more target RNA molecules, binding the one or more target RNA molecules, editing the one or more target RNA molecules, trafficking the one or more target RNA molecules, and masking the one or more target RNA molecules. In some example, modifying one or more target RNA molecules includes one or more of an RNA base substitution, an RNA base deletion, an RNA base insertion, a break in the target RNA, methylating RNA, and demethylating RNA.

In some examples, such methods are used to treat a disease, such as a disease in a human. In such examples, the one or more target RNA molecules is associated with the disease Also provided are isolated proteins, including non-naturally occurring proteins. In some examples, a protein has at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, or 113. In some examples, an isolated protein is an Cas13d ortholog from a prokaryotic genome or metagenome, gut metagenome, an activated sludge metagenome, an anaerobic digester metagenome, a chicken gut metagenome, a human gut metagenome, a pig gut metagenome, a bovine gut metagenome, a sheep gut metagenome, a goat gut metagenome, a capybara gut metagenome, a primate gut metagenome, a termite gut metagenome, a fecal metagenome, a genome from the Order Clostridiales, or the Family Ruminococcaceae. In some examples, an Cas13d ortholog includes an Cas13d ortholog from *Ruminococcus albus*, *Eubacterium siraeum*, a *Ruminococcus flavefaciens* strain XPD3002, *Ruminococcus flavefaciens* FD-1, uncultured *Eubacterium* sp TS28-c4095, uncultured *Ruminococcus* sp., *Ruminococcus bicirculans*, or *Ruminococcus* sp CAG57. The protein is an Cas13d protein that further includes one or more other agents or domains (e.g., is a fusion protein), such as one or more subcellular localization signals, one or more effector domains, or combinations thereof.

Also provided are isolated guide RNA (gRNA) molecules. In some examples, an isolated gRNA includes one or more direct repeat (DR) sequences, such as an unprocessed (e.g., about 36 nt) or processed DR (e.g., about 30 nt). In some examples a DR has at least 80%, at least 85%, at least 90%, at least 92%, at least 95%, at least 96%, at least 97%, at least 98%, at least 99%, or 100% sequence identity to SEQ ID NO: 129, 130, 131, 132, 133, 134, 135, 136, 137, 148, 150, 151, 152, 154, 156, 157, 159, 161, 163, 165, 167, 169, 176, 178, 180, 182, 184, 186, 188, 190, 191, 192, 193, 199, 201, 203, 205, 207, 209, 211, 213, 215, 217, 219, 221, 223, 225, 227, 228, 230, 232, 234, 236, 238, 240, 242, 244, 246, 248, 250, 252, or 254. Such a gRNA can further include one or more spacer sequences specific for (e.g., is complementary to) the target RNA.

Also provided are ribonucleoprotein (RNP) complexes, which include an Cas13d protein provided herein and a gRNA provided herein.

Also provided are recombinant cells that include any Cas13d protein (or nucleic acid molecule encoding Cas13d), any gRNA, any RNP complex, or any vector, provided herein. In one example, the cell is not a bacterial cell. In one example, the cell is a bacterial cell.

Also provided are compositions that include one or more of any Cas13d protein (or nucleic acid molecule encoding Cas13d), any gRNA, any RNP complex, any isolated nucleic acid molecule, any vector, or any cell, provided herein. Such compositions can include a pharmaceutically acceptable carrier.

Also provided are kits. Such kits can include one or more of any Cas13d protein (or nucleic acid molecule encoding Cas13d), any gRNA, any RNP complex, any isolated nucleic acid molecule, any vector, any cell, or any composition provided herein. Such reagents can be combined or in separate containers.

The foregoing and other objects and features of the disclosure will become more apparent from the following detailed description, which proceeds with reference to the accompanying figures.

BRIEF DESCRIPTION OF THE DRAWINGS

FIGS. 4A-4C: Purification of recombinant Cas13d protein. EsCas13d was expressed as N-terminal His-MBP fusion and purified by successive affinity, cation exchange, and size exclusion chromatography. The His-tag was removed by TEV protease cleavage. (A) Chromatogram from Superdex 200 column for EsCas13d. (B) SDS-PAGE gel of size exclusion chromatography fractions for *E. siraeum* Cas13d. (C) SDS-PAGE gel of purified *E. siraeum* Cas13d and dCas13d (R295A, H300A, R849A, H854A mutations of predicted catalytic residues in both HEPN motifs).

FIGS. 6A-6H. In vitro characterization of Cas13d properties. (A) Schematic showing the length and sequence of gRNA spacer truncations and spacer position relative to the complementary ssRNA target (from top to bottom, SEQ ID NOS: 295 to 309). (B) Denaturing gel depicting EsCas13d cleavage activity of target RNA with different spacer lengths. (C) Denaturing gel depicting EsCas13d cleavage reactions paired with 12 guides from FIG. 3A tiling a complementary ssDNA version of the ssRNA target. (D) Denaturing gel depicting cleavage reactions using EsCas13d paired with the same 12 guides tiling a dsDNA version of the complementary target. (E) Quantification of cleavage efficiency from FIG. 3A. Each PFS base is the average of 3 different spacer sequences tiling a complementary target RNA. Cleavage percentage is determined by the ratio of cleaved band intensity divided by total lane intensity. Mean is depicted±SD with each data point representing an independent replicate. (F) Cas13d -mediated cleavage of target RNA carrying different PFS bases given an invariant spacer sequence. Quantification of Cas13d cleavage efficiency and a representative denaturing gel depicting EsCas13d cleavage activity are shown. Differences are not significant (one-way ANOVA, P=0.768). Cleavage percentage is determined as above, and mean is depicted±SD with n=3. (G) and (H) Optimal temperature range for Cas13d activity. Denaturing gels depicting EsCas13d cleavage activity at temperatures ranging from 16-62° C. for two different target RNAs.

FIGS. 9A-9H: CasRx mediates efficient and specific knockdown of diverse human coding and noncoding transcripts. (A) Multiple guide RNAs tiling a target transcript can be expressed as a single array and processed by RfxCas13d-NLS (CasRx) into individual gRNAs within the same cell. (B) Arrays of 4 guides each mediate target knockdown by CasRx in 293FT cells via transient transfection. Knockdown relative to GFP vehicle control was determined by qPCR, with n=3. (C) Schematic of CasRx target sequences and spacer position-matched shRNAs. (D) Relative target RNA knockdown by individual position-matched shRNAs and CasRx gRNAs. NT, non-targeting. CRISPRi, dCas9-mediated CRISPR interference for transcriptional repression (n=3) (E) Volcano plot of differential transcript levels between B4GALNT1 targeting and non-targeting (NT) shRNAs as determined by RNA sequencing (n=3). 542 non-specific transcript changes were identified. (F) Volcano plot of differential transcript levels between B4GALNT1-targeting CasRx and non-targeting (NT) guide. Targeting guide position is matched to the shRNA shown in (E). B4GALNT1 was the only transcript exhibiting a significant change, with n=3. (G) Summary of significant off-target transcript perturbations by matched shRNAs and CasRx guides. (H) CasRx targeting of 11 endogenous transcripts, each with 3 guides and a non-targeting (NT) guide in 293FT cells. Transcript levels are relative to GFP vehicle control, mean±SEM with n=3.

FIGS. 10A-10D. Comparison of engineered Cas13 superfamily effectors for targeted knockdown and splicing. (A) Relative target RNA knockdown by individual position-matched gRNAs for CasRx, NLS-LwaCas13a-msfGFP (Abudayyeh et al., 2017) and PspCas13b-NES (Cox et al., 2017) in HEK 293FT cells. NT, non-targeting. Values are mean±SEM with n=3. (B) Comparison of Cas13 median knockdown efficiencies. n=3 per guide RNA. ** indicates P<0.0001 according to Friedman's test. (C) Exon exclusion by catalytically inactive NLS-dCas13a-msfGFP on the bichromatic splicing reporter. Guides are position-matched to those reported in FIG. 6B for CasRx. Values are mean±SEM with n=3. (D) Comparison of splicing modulation by NLS-dCas13a-msfGFP and CasRx. Fold change in targeted exon exclusion relative to non-targeting guide is shown. ** indicates P<0.0001 according to two-way ANOVA.

FIGS. 18A-18MMM show an alignment of 53 different Cas13d proteins as follows: SEQ ID NOs: 310 (037_-_emb|OIZA01000315.1), 183 (emb|OCTW011587266.1), 189 (k87_11092736), 220 (BMZ-11B_GL0037915), 218 (BMZ-11B_GL0037771), 222 (BMZ-11B_GL0069617), 229 (Ga0099364_10024192), 216 (530373_GL0023589), 177 (emb|ODAI011611274.1), 200 (EMG_10003641), 139 (CasR_P1E0_metageno), 179 (emb|OIZX01000427.1), 208 (160582958_gene49834), 166 (gi|1198542314|gb|NFIR01000008.1), 185 (emb|OGNF01009141.1), 202 (Ga0129306_1000735), 239 (MH0288_GL0082219), 311 (PIG-022_GL0026351), 249 (PIG-028_GL0185479), 210 (250_twins_35838 GL0110300), 243 (PIG-014_GL0226364), 212 (250twins_36050_GL0158985), 175 (emb|OJMM01002900.1), 164 (emb|OGPN01002610.1), 160 (emb|OHCP01000044.1), 312 (PIG-046_GL0077813), 313 (pig_chimera), 187 (emb|OIEN01002196.1), 241 (02.UC29-0_GL0096317), 140 (CasR_Anaerobic_dig), 162 (emb|OGDF01008514.1), 155 (emb|OGZC01000639.1), 206 (Ga0224415_10048792_chimera), 181 (emb|OCVV012889144.1), 231 (Ga0187910_10006931), 92 (R._flav_XPD), 198 (Ga0224415_10007274), 237 (Ga0187911_10069260), 233 (Ga0187910_10015336), 253 (ODAI_chimera), 214 (31009_GL0034153), 224 (DLF014_GL0011914), 127 (CasR_R. albus), 235 (Ga0187910_10040531), 153 (tpg|DJXD01000002.1), 125 (CasR_E. siraeum), 245 (PIG-018_GL0023397), 247 (PIG-025_GL0099734), 204 (Ga0129317_1008067_chimera), 226 (EYZ-362B_GL0088915), 3 (uncultured_Ru_sp), 126 (R._flav._FD-1), and 149 (tpg|DBYI01000091.1), from top to bottom.

SEQUENCE LISTING

Figure 1A:
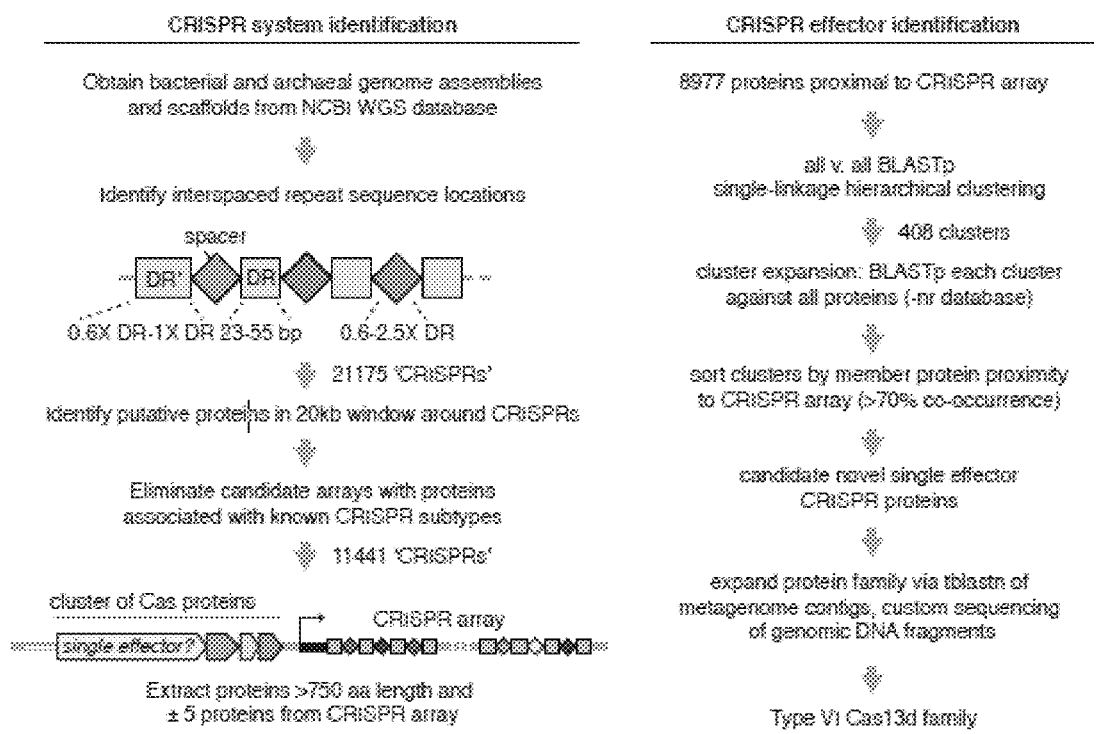
FIGS. 1A-1B: Bioinformatic pipeline for the identification of the RNA-targeting class 2 CRISPR system Cas13d. (A) Schematic describing a computational pipeline for CRISPR system identification. A minimal definition for a putative class 2 CRISPR locus was used, requiring only a CRISPR repeat array and a nearby protein >750 aa in length. The initial search was performed on prokaryotic genome assemblies derived from NCBI Genome, and later expanded via TBLASTN of predicted Cas13d proteins against public metagenome sequences without predicted open reading frames. DR, direct repeat. (B) Phylogenetic classification and alignment of full-length Cas13d effectors and metagenomic fragments. Cas13d effectors and metagenomic Cas13d protein fragments cluster into several distinct branches, which are colored for ease of interpretation. Shading indicates residue conservation using the Blosum62 matrix. Full-length Cas13d effectors used in this study were sampled from distinct branches of the Cas13d family. Alignment of Cas13d proteins and protein fragments was performed using ClustalOmega 1.2.4 and maximum-likelihood tree building was performed with PhyML 3.2.

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file, created on Jul. 31, 2019, 928 KB, which is incorporated by reference herein. In the accompanying sequence listing:

SEQ ID NO: 1 is an exemplary Cas13d sequence from *Eubacterium siraeum* containing a HEPN site.

SEQ ID NO: 2 is an exemplary Cas13d sequence from *Eubacterium siraeum* containing a mutated HEPN site.

SEQ ID NO: 3 is an exemplary Cas13d sequence from uncultured *Ruminococcus* sp. containing a HEPN site.

SEQ ID NO: 4 is an exemplary Cas13d sequence from uncultured *Ruminococcus* sp. containing a mutated HEPN site.

SEQ ID NO: 5 is an exemplary Cas13d sequence from Gut_metagenome_contig2791000549.

SEQ ID NO: 6 is an exemplary Cas13d sequence from Gut_metagenome_contig855000317.

SEQ ID NO: 7 is an exemplary Cas13d sequence from Gut_metagenome_contig3389000027.

SEQ ID NO: 8 is an exemplary Cas13d sequence from Gut_metagenome_contig8061000170.

SEQ ID NO: 9 is an exemplary Cas13d sequence from Gut_metagenome_contig1509000299.

SEQ ID NO: 10 is an exemplary Cas13d sequence from Gut_metagenome_contig9549000591.

SEQ ID NO: 11 is an exemplary Cas13d sequence from Gut_metagenome_contig71000500.

SEQ ID NO: 12 is an exemplary Cas13d sequence from human gut metagenome.

SEQ ID NO: 13 is an exemplary Cas13d sequence from Gut_metagenome_contig3915000357.

SEQ ID NO: 14 is an exemplary Cas13d sequence from Gut_metagenome_contig4719000173.

SEQ ID NO: 15 is an exemplary Cas13d sequence from Gut_metagenome_contig6929000468.

SEQ ID NO: 16 is an exemplary Cas13d sequence from Gut_metagenome_contig7367000486.

SEQ ID NO: 17 is an exemplary Cas13d sequence from Gut_metagenome_contig7930000403.

SEQ ID NO: 18 is an exemplary Cas13d sequence from Gut_metagenome_contig993000527.

SEQ ID NO: 19 is an exemplary Cas13d sequence from Gut_metagenome_contig6552000639.

SEQ ID NO: 20 is an exemplary Cas13d sequence from Gut_metagenome_contig11932000246.

SEQ ID NO: 21 is an exemplary Cas13d sequence from Gut_metagenome_contig12963000286.

SEQ ID NO: 22 is an exemplary Cas13d sequence from Gut_metagenome_contig2952000470.

SEQ ID NO: 23 is an exemplary Cas13d sequence from Gut_metagenome_contig451000394.

SEQ ID NO: 24 is an exemplary Cas13d sequence from *Eubacterium_siraeum*_DSM_15702.

SEQ ID NO: 25 is an exemplary Cas13d sequence from gut_metagenome_P19E0k2120140920,_c369000003.

SEQ ID NO: 26 is an exemplary Cas13d sequence from Gut_metagenome_contig7593000362.

SEQ ID NO: 27 is an exemplary Cas13d sequence from Gut_metagenome_contig12619000055.

SEQ ID NO: 28 is an exemplary Cas13d sequence from Gut_metagenome_contig1405000151.

SEQ ID NO: 29 is an exemplary Cas13d sequence from Chicken_gut_metagenome_c298474.

SEQ ID NO: 30 is an exemplary Cas13d sequence from Gut_metagenome_contig1516000227.

SEQ ID NO: 31 is an exemplary Cas13d sequence from Gut_metagenome_contig1838000319.

SEQ ID NO: 32 is an exemplary Cas13d sequence from Gut_metagenome_contig13123000268.

SEQ ID NO: 33 is an exemplary Cas13d sequence from Gut_metagenome_contig5294000434.

SEQ ID NO: 34 is an exemplary Cas13d sequence from Gut_metagenome_contig6415000192.

SEQ ID NO: 35 is an exemplary Cas13d sequence from Gut_metagenome_contig6144000300.

SEQ ID NO: 36 is an exemplary Cas13d sequence from Gut_metagenome_contig9118000041.

SEQ ID NO: 37 is an exemplary Cas13d sequence from Activated_sludge_metagenome_transcript_24486.

SEQ ID NO: 38 is an exemplary Cas13d sequence from Gut_metagenome_contig1322000437.

SEQ ID NO: 39 is an exemplary Cas13d sequence from Gut_metagenome_contig4582000531.

SEQ ID NO: 40 is an exemplary Cas13d sequence from Gut_metagenome_contig9190000283.

SEQ ID NO: 41 is an exemplary Cas13d sequence from Gut_metagenome_contig1709000510.

SEQ ID NO: 42 is an exemplary Cas13d sequence from M24_(LSQX01212483_Anaerobic_digester_metagenome) with a HEPN domain.

SEQ ID NO: 43 is an exemplary Cas13d sequence from Gut_metagenome_contig3833000494.

SEQ ID NO: 44 is an exemplary Cas13d sequence from Activated_sludge_metagenome_transcript_17355.

SEQ ID NO: 45 is an exemplary Cas13d sequence from Gut_metagenome_contig11061000330.

SEQ ID NO: 46 is an exemplary Cas13d sequence from Gut_metagenome_contig338000322 from sheep gut metagenome.

SEQ ID NO: 47 is an exemplary Cas13d sequence from human gut metagenome.

SEQ ID NO: 48 is an exemplary Cas13d sequence from Gut_metagenome_contig9530000097.

SEQ ID NO: 49 is an exemplary Cas13d sequence from Gut_metagenome_contig1750000258.

SEQ ID NO: 50 is an exemplary Cas13d sequence from Gut_metagenome_contig5377000274.

SEQ ID NO: 51 is an exemplary Cas13d sequence from gut_metagenome_P19E0k2120140920_c248000089.

SEQ ID NO: 52 is an exemplary Cas13d sequence from Gut_metagenome_contig11400000031.

SEQ ID NO: 53 is an exemplary Cas13d sequence from Gut_metagenome_contig7940000191.

SEQ ID NO: 54 is an exemplary Cas13d sequence from Gut_metagenome_contig6049000251.

SEQ ID NO: 55 is an exemplary Cas13d sequence from Gut_metagenome_contig1137000500.

SEQ ID NO: 56 is an exemplary Cas13d sequence from Gut_metagenome_contig9368000105.

SEQ ID NO: 57 is an exemplary Cas13d sequence from Gut_metagenome_contig546000275.

SEQ ID NO: 58 is an exemplary Cas13d sequence from Gut_metagenome_contig7216000573.

SEQ ID NO: 59 is an exemplary Cas13d sequence from Gut_metagenome_contig4806000409.

SEQ ID NO: 60 is an exemplary Cas13d sequence from Gut_metagenome_contig110762000480.

SEQ ID NO: 61 is an exemplary Cas13d sequence from Gut_metagenome_contig4114000374.

SEQ ID NO: 62 is an exemplary Cas13d sequence from *Ruminococcus_flavefaciens*_FD1.

SEQ ID NO: 63 is an exemplary Cas13d sequence from Gut_metagenome_contig7093000170.

SEQ ID NO: 64 is an exemplary Cas13d sequence from Gut_metagenome_contig11113000384.

SEQ ID NO: 65 is an exemplary Cas13d sequence from Gut_metagenome_contig6403000259.

SEQ ID NO: 66 is an exemplary Cas13d sequence from Gut_metagenome_contig6193000124.

SEQ ID NO: 67 is an exemplary Cas13d sequence from Gut_metagenome_contig721000619.

SEQ ID NO: 68 is an exemplary Cas13d sequence from Gut_metagenome_contig1666000270.

SEQ ID NO: 69 is an exemplary Cas13d sequence from Gut_metagenome_contig2002000411.

SEQ ID NO: 70 is an exemplary Cas13d sequence from *Ruminococcus_albus*.

SEQ ID NO: 71 is an exemplary Cas13d sequence from Gut_metagenome_contig13552000311.

SEQ ID NO: 72 is an exemplary Cas13d sequence from Gut_metagenome_contig10037000527.

SEQ ID NO: 73 is an exemplary Cas13d sequence from Gut_metagenome_contig238000329.

SEQ ID NO: 74 is an exemplary Cas13d sequence from Gut_metagenome_contig2643000492.

SEQ ID NO: 75 is an exemplary Cas13d sequence from Gut_metagenome_contig874000057.

SEQ ID NO: 76 is an exemplary Cas13d sequence from Gut_metagenome_contig4781000489.

SEQ ID NO: 77 is an exemplary Cas13d sequence from Gut_metagenome_contig12144000352.

SEQ ID NO: 78 is an exemplary Cas13d sequence from Gut_metagenome_contig5590000448.

SEQ ID NO: 79 is an exemplary Cas13d sequence from Gut_metagenome_contig92690000031.

SEQ ID NO: 80 is an exemplary Cas13d sequence from Gut_metagenome_contig8537000520.

SEQ ID NO: 81 is an exemplary Cas13d sequence from Gut_metagenome_contig1845000130.

SEQ ID NO: 82 is an exemplary Cas13d sequence from gut_metagenome_P13E0k2120140920_c3000072.

SEQ ID NO: 83 is an exemplary Cas13d sequence from gut_metagenome_P1E0k2120140920_c1000078.

SEQ ID NO: 84 is an exemplary Cas13d sequence from Gut_metagenome_contig12990000099.

SEQ ID NO: 85 is an exemplary Cas13d sequence from Gut_metagenome_contig525000349.

SEQ ID NO: 86 is an exemplary Cas13d sequence from Gut_metagenome_contig7229000302.

SEQ ID NO: 87 is an exemplary Cas13d sequence from Gut_metagenome_contig3227000343.

SEQ ID NO: 88 is an exemplary Cas13d sequence from Gut_metagenome_contig7030000469.

SEQ ID NO: 89 is an exemplary Cas13d sequence from Gut_metagenome_contig5149000068.

SEQ ID NO: 90 is an exemplary Cas13d sequence from Gut_metagenome_contig400200045.

SEQ ID NO: 91 is an exemplary Cas13d sequence from Gut_metagenome_contig10420000446.

SEQ ID NO: 92 is an exemplary Cas13d sequence from new_flavefaciens,_strain_XPD3002.

SEQ ID NO: 93 is an exemplary Cas13d sequence from M26_Gut_metagenome_contig698000307.

SEQ ID NO: 94 is an exemplary Cas13d sequence from M36_Uncultured_Eubacterium_sp_TS28_c40956.

SEQ ID NO: 95 is an exemplary Cas13d sequence from M12_gut_metagenome_P25C0k2120140920_c134000066.

SEQ ID NO: 96 is an exemplary Cas13d sequence from human gut metagenome.

SEQ ID NO: 97 is an exemplary Cas13d sequence from M10_gut_metagenome_P25C90k2120140920,_c28000041.

SEQ ID NO: 98 is an exemplary Cas13d sequence from M11_gut_metagenome_P25C7k2120140920_c4078000105.

SEQ ID NO: 99 is an exemplary Cas13d sequence from gut_metagenome_P25C0k2120140920_c32000045.

SEQ ID NO: 100 is an exemplary Cas13d sequence from M13_gut_metagenome_P23C7k2120140920_c3000067.

SEQ ID NO: 101 is an exemplary Cas13d sequence from M5_gut_metagenome_P18E90k2120140920.

SEQ ID NO: 102 is an exemplary Cas13d sequence from M21_gut_metagenome_P18E0k2120140920.

SEQ ID NO: 103 is an exemplary Cas13d sequence from M7_gut_metagenome_P38C7k2120140920_c4841000003.

SEQ ID NO: 104 is an exemplary Cas13d sequence from Ruminococcus_bicirculans.

SEQ ID NO: 105 is an exemplary Cas13d sequence.

SEQ ID NO: 106 is an exemplary Cas13d consensus sequence.

SEQ ID NO: 107 is an exemplary Cas13d sequence from M18_gut_metagenome_P22E0k2120140920_c3395000078.

SEQ ID NO: 108 is an exemplary Cas13d sequence from M17_gut_metagenome_P22E90k2120140920_c114.

SEQ ID NO: 109 is an exemplary Cas13d sequence from Ruminococcus_sp_CAG57.

SEQ ID NO: 110 is an exemplary Cas13d sequence from gut_metagenome_P11E90k2120140920_c43000123.

SEQ ID NO: 111 is an exemplary Cas13d sequence from M6_gut_metagenome_P13E90k2120140920_c7000009.

SEQ ID NO: 112 is an exemplary Cas13d sequence from M19_gut_metagenome_P17E90k2120140920.

SEQ ID NO: 113 is an exemplary Cas13d sequence from gut_metagenome_P17E0k2120140920,_c87000043.

SEQ ID NO: 114 is an exemplary human codon optimized Eubacterium siraeum Cas13d nucleic acid sequence.

SEQ ID NO: 115 is an exemplary human codon optimized Eubacterium siraeum Cas13d nucleic acid sequence with a mutant HEPN domain.

SEQ ID NO: 116 is an exemplary human codon-optimized Eubacterium siraeum Cas13d nucleic acid sequence with N-terminal NLS.

SEQ ID NO: 117 is an exemplary human codon-optimized Eubacterium siraeum Cas13d nucleic acid sequence with N- and C-terminal NLS tags.

SEQ ID NO: 118 is an exemplary human codon-optimized uncultured Ruminococcus sp. Cas13d nucleic acid sequence.

SEQ ID NO: 119 is an exemplary human codon-optimized uncultured Ruminococcus sp. Cas13d nucleic acid sequence with a mutant HEPN domain.

SEQ ID NO: 120 is an exemplary human codon-optimized uncultured Ruminococcus sp. Cas13d nucleic acid sequence with N-terminal NLS.

SEQ ID NO: 121 is an exemplary human codon-optimized uncultured Ruminococcus sp. Cas13d nucleic acid sequence with N- and C-terminal NLS tags.

SEQ ID NO: 122 is an exemplary human codon-optimized uncultured Ruminococcus flavefaciens FD1 Cas13d nucleic acid sequence.

SEQ ID NO: 123 is an exemplary human codon-optimized uncultured Ruminococcus flavefaciens FD1 Cas13d nucleic acid sequence with mutated HEPN domain.

SEQ ID NO: 124 is an exemplary Cas13d nucleic acid sequence from Ruminococcus bicirculans.

SEQ ID NO: 125 is an exemplary Cas13d nucleic acid sequence from Eubacterium siraeum.

SEQ ID NO: 126 is an exemplary Cas13d nucleic acid sequence from Ruminococcus flavefaciens FD1.

SEQ ID NO: 127 is an exemplary Cas13d nucleic acid sequence from Ruminococcus albus.

SEQ ID NO: 128 is an exemplary Cas13d nucleic acid sequence from Ruminococcus flavefaciens XPD.

SEQ ID NO: 129 is an exemplary consensus DR nucleic acid sequence for E. siraeum Cas13d.

SEQ ID NO: 130 is an exemplary consensus DR nucleic acid sequence for Rum. Sp. Cas13d.

SEQ ID NO: 131 is an exemplary consensus DR nucleic acid sequence for Rum. Flavefaciens strain XPD3002 Cas13d and CasRx.

SEQ ID NOS: 132-137 are exemplary consensus DR nucleic acid sequences.

SEQ ID NO: 138 is an exemplary 50% consensus sequence for seven full-length Cas13d orthologues.

SEQ ID NO: 139 is an exemplary Cas13d nucleic acid sequence from Gut metagenome P1E0.

SEQ ID NO: 140 is an exemplary Cas13d nucleic acid sequence from Anaerobic digester.

SEQ ID NO: 141 is an exemplary Cas13d nucleic acid sequence from Ruminococcus sp. CAG:57.

SEQ ID NO: 142 is an exemplary human codon-optimized uncultured Gut metagenome P1E0 Cas13d nucleic acid sequence.

SEQ ID NO: 143 is an exemplary human codon-optimized Anaerobic Digester Cas13d nucleic acid sequence.

SEQ ID NO: 144 is an exemplary human codon-optimized Ruminococcus flavefaciens XPD Cas13d nucleic acid sequence.

SEQ ID NO: 145 is an exemplary human codon-optimized Ruminococcus albus Cas13d nucleic acid sequence.

SEQ ID NO: 146 is an exemplary processing of the Ruminococcus sp. CAG:57 CRISPR array.

SEQ ID NO: 147 is an exemplary Cas13d protein sequence from contig emb|OBVH01003037.1, human gut metagenome sequence (also found in WGS contigs emb|OBXZ01000094.1| and emb|OBJF01000033.1.

SEQ ID NO: 148 is an exemplary consensus DR nucleic acid sequence (goes with SEQ ID NO: 147).

SEQ ID NO: 149 is an exemplary Cas13d protein sequence from contig tpg|DBYI01000091.1| (Uncultivated *Ruminococcus flavefaciens* UBA1190 assembled from bovine gut metagenome).

SEQ ID NOS: 150-152 are exemplary consensus DR nucleic acid sequences (goes with SEQ ID NO: 149).

SEQ ID NO: 153 is an exemplary Cas13d protein sequence from contig tpg|DJXD01000002.1| (uncultivated *Ruminococcus* assembly, UBA7013, from sheep gut metagenome).

SEQ ID NO: 154 is an exemplary consensus DR nucleic acid sequence (goes with SEQ ID NO: 153).

SEQ ID NO: 155 is an exemplary Cas13d protein sequence from contig OGZC01000639.1 (human gut metagenome assembly).

SEQ ID NOS: 156-177 are exemplary consensus DR nucleic acid sequences (goes with SEQ ID NO: 155).

SEQ ID NO: 158 is an exemplary Cas13d protein sequence from contig emb|OHBM01000764.1 (human gut metagenome assembly).

SEQ ID NO: 159 is an exemplary consensus DR nucleic acid sequence (goes with SEQ ID NO: 158).

SEQ ID NO: 160 is an exemplary Cas13d protein sequence from contig emb|OHCP01000044.1 (human gut metagenome assembly).

SEQ ID NO: 161 is an exemplary consensus DR nucleic acid sequence (goes with SEQ ID NO: 160).

SEQ ID NO: 162 is an exemplary Cas13d protein sequence from contig emb|OGDF01008514.1| (human gut metagenome assembly).

SEQ ID NO: 163 is an exemplary consensus DR nucleic acid sequence (goes with SEQ ID NO: 162).

SEQ ID NO: 164 is an exemplary Cas13d protein sequence from contig emb|OGPN01002610.1 (human gut metagenome assembly).

SEQ ID NO: 165 is an exemplary consensus DR nucleic acid sequence (goes with SEQ ID NO: 164).

SEQ ID NO: 166 is an exemplary Cas13d protein sequence from contig NFIR01000008.1 (*Eubacterium* sp. An3, from chicken gut metagenome).

SEQ ID NO: 167 is an exemplary consensus DR nucleic acid sequence (goes with SEQ ID NO: 166).

SEQ ID NO: 168 is an exemplary Cas13d protein sequence from contig NFLV01000009.1 (*Eubacterium* sp. An11, from chicken gut metagenome).

SEQ ID NO: 169 is an exemplary consensus DR nucleic acid sequence (goes with SEQ ID NO: 168).

SEQ ID NOS: 171-174 are an exemplary Cas13d motif sequences.

SEQ ID NO: 175 is an exemplary Cas13d protein sequence from contig OJMM01002900 human gut metagenome sequence.

SEQ ID NO: 176 is an exemplary consensus DR nucleic acid sequence (goes with SEQ ID NO: 175).

SEQ ID NO: 177 is an exemplary Cas13d protein sequence from contig ODAI011611274.1 gut metagenome sequence.

SEQ ID NO: 178 is an exemplary consensus DR nucleic acid sequence (goes with SEQ ID NO: 177).

SEQ ID NO: 179 is an exemplary Cas13d protein sequence from contig OIZX01000427.1.

SEQ ID NO: 180 is an exemplary consensus DR nucleic acid sequence (goes with SEQ ID NO: 179).

SEQ ID NO: 181 is an exemplary Cas13d protein sequence from contig emb|OCVV012889144.1.

SEQ ID NO: 182 is an exemplary consensus DR nucleic acid sequence (goes with SEQ ID NO: 181).

SEQ ID NO: 183 is an exemplary Cas13d protein sequence from contig OCTW011587266.1

SEQ ID NO: 184 is an exemplary consensus DR nucleic acid sequence (goes with SEQ ID NO: 183).

SEQ ID NO: 185 is an exemplary Cas13d protein sequence from contig emb|OGNF01009141.1.

SEQ ID NO: 186 is an exemplary consensus DR nucleic acid sequence (goes with SEQ ID NO: 185).

SEQ ID NO: 187 is an exemplary Cas13d protein sequence from contig emb|OIEN01002196.1.

SEQ ID NO: 188 is an exemplary consensus DR nucleic acid sequence (goes with SEQ ID NO: 187).

SEQ ID NO: 189 is an exemplary Cas13d protein sequence from contig e-k87_11092736.

SEQ ID NO: 190-193 are exemplary consensus DR nucleic acid sequences (goes with SEQ ID NO: 189).

SEQ ID NO: 194 is an exemplary Cas13d sequence from Gut_metagenome_contig6893000291.

SEQ ID NO: 195-197 are exemplary Cas13d motif sequences.

SEQ ID NO: 198 is an exemplary Cas13d protein sequence from Ga0224415_10007274.

SEQ ID NO: 199 is an exemplary consensus DR nucleic acid sequence (goes with SEQ ID NO: 198).

SEQ ID NO: 200 is an exemplary Cas13d protein sequence from EMG_10003641.

SEQ ID NO: 201 is an exemplary consensus DR nucleic acid sequence (goes with SEQ ID NO: 200).

SEQ ID NO: 202 is an exemplary Cas13d protein sequence from Ga0129306_1000735.

SEQ ID NO: 203 is an exemplary consensus DR nucleic acid sequence (goes with SEQ ID NO: 202).

SEQ ID NO: 204 is an exemplary Cas13d protein sequence from Ga0129317_1008067.

SEQ ID NO: 205 is an exemplary consensus DR nucleic acid sequence (goes with SEQ ID NO: 204).

SEQ ID NO: 206 is an exemplary Cas13d protein sequence from Ga0224415_10048792.

SEQ ID NO: 207 is an exemplary consensus DR nucleic acid sequence (goes with SEQ ID NO: 206).

SEQ ID NO: 208 is an exemplary Cas13d protein sequence from 160582958_gene49834.

SEQ ID NO: 209 is an exemplary consensus DR nucleic acid sequence (goes with SEQ ID NO: 208).

SEQ ID NO: 210 is an exemplary Cas13d protein sequence from 250twins_35838_GL0110300.

SEQ ID NO: 211 is an exemplary consensus DR nucleic acid sequence (goes with SEQ ID NO: 210).

SEQ ID NO: 212 is an exemplary Cas13d protein sequence from 250twins_36050_GL0158985.

SEQ ID NO: 213 is an exemplary consensus DR nucleic acid sequence (goes with SEQ ID NO: 212).

SEQ ID NO: 214 is an exemplary Cas13d protein sequence from 31009_GL0034153.

SEQ ID NO: 215 is an exemplary consensus DR nucleic acid sequence (goes with SEQ ID NO: 214).

SEQ ID NO: 216 is an exemplary Cas13d protein sequence from 530373_GL0023589.

SEQ ID NO: 217 is an exemplary consensus DR nucleic acid sequence (goes with SEQ ID NO: 216).

SEQ ID NO: 218 is an exemplary Cas13d protein sequence from BMZ-11B_GL0037771.

SEQ ID NO: 219 is an exemplary consensus DR nucleic acid sequence (goes with SEQ ID NO: 218).

SEQ ID NO: 220 is an exemplary Cas13d protein sequence from BMZ-11B_GL0037915.

SEQ ID NO: 221 is an exemplary consensus DR nucleic acid sequence (goes with SEQ ID NO: 220).

SEQ ID NO: 222 is an exemplary Cas13d protein sequence from BMZ-11B_GL0069617.

SEQ ID NO: 223 is an exemplary consensus DR nucleic acid sequence (goes with SEQ ID NO: 222).

SEQ ID NO: 224 is an exemplary Cas13d protein sequence from—DLF014_GL0011914.

SEQ ID NO: 225 is an exemplary consensus DR nucleic acid sequence (goes with SEQ ID NO: 224).

SEQ ID NO: 226 is an exemplary Cas13d protein sequence from EYZ-362B_GL0088915.

SEQ ID NO: 227-228 are exemplary consensus DR nucleic acid sequences (goes with SEQ ID NO: 226).

SEQ ID NO: 229 is an exemplary Cas13d protein sequence from Ga0099364_10024192.

SEQ ID NO: 230 is an exemplary consensus DR nucleic acid sequence (goes with SEQ ID NO: 229).

SEQ ID NO: 231 is an exemplary Cas13d protein sequence from Ga0187910_10006931.

SEQ ID NO: 232 is an exemplary consensus DR nucleic acid sequence (goes with SEQ ID NO: 231).

SEQ ID NO: 233 is an exemplary Cas13d protein sequence from Ga0187910_10015336.

SEQ ID NO: 234 is an exemplary consensus DR nucleic acid sequence (goes with SEQ ID NO: 233).

SEQ ID NO: 235 is an exemplary Cas13d protein sequence from Ga0187910_10040531.

SEQ ID NO: 236 is an exemplary consensus DR nucleic acid sequence (goes with SEQ ID NO: 235).

SEQ ID NO: 237 is an exemplary Cas13d protein sequence from Ga0187911_10069260.

SEQ ID NO: 238 is an exemplary consensus DR nucleic acid sequence (goes with SEQ ID NO: 237).

SEQ ID NO: 239 is an exemplary Cas13d protein sequence from MH0288_GL0082219.

SEQ ID NO: 240 is an exemplary consensus DR nucleic acid sequence (goes with SEQ ID NO: 239).

SEQ ID NO: 241 is an exemplary Cas13d protein sequence from O2.UC29-0_GL0096317.

SEQ ID NO: 242 is an exemplary consensus DR nucleic acid sequence (goes with SEQ ID NO: 241).

SEQ ID NO: 243 is an exemplary Cas13d protein sequence from PIG-014_GL0226364.

SEQ ID NO: 244 is an exemplary consensus DR nucleic acid sequence (goes with SEQ ID NO: 243).

SEQ ID NO: 245 is an exemplary Cas13d protein sequence from PIG-018_GL0023397.

SEQ ID NO: 246 is an exemplary consensus DR nucleic acid sequence (goes with SEQ ID NO: 245).

SEQ ID NO: 247 is an exemplary Cas13d protein sequence from PIG-025_GL0099734.

SEQ ID NO: 248 is an exemplary consensus DR nucleic acid sequence (goes with SEQ ID NO: 247).

SEQ ID NO: 249 is an exemplary Cas13d protein sequence from PIG-028_GL0185479.

SEQ ID NO: 250 is an exemplary consensus DR nucleic acid sequence (goes with SEQ ID NO: 249).

SEQ ID NO: 251 is an exemplary Cas13d protein sequence from—Ga0224422_10645759.

SEQ ID NO: 252 is an exemplary consensus DR nucleic acid sequence (goes with SEQ ID NO: 251).

SEQ ID NO: 253 is an exemplary Cas13d protein sequence from ODAI chimera.

SEQ ID NO: 254 is an exemplary consensus DR nucleic acid sequence (goes with SEQ ID NO: 253).

SEQ ID NO: 255 is an HEPN motif.

SEQ ID NOs: 256 and 257 are exemplary Cas13d nuclear localization signal amino acid and nucleic acid sequences, respectively.

SEQ ID NOs: 258 and 260 are exemplary SV40 large T antigen nuclear localization signal amino acid and nucleic acid sequences, respectively.

SEQ ID NO: 259 is a dCas9 target sequence.

SEQ ID NO: 261 is an artificial *Eubacterium siraeum* nCas1 array targeting ccdB.

SEQ ID NO: 262 is a full 36 nt direct repeat.

SEQ ID NOs: 263-266 are spacer sequences.

SEQ ID NO: 267 is an artificial uncultured *Ruminoccus* sp. nCas1 array targeting ccdB.

SEQ ID NO: 268 is a full 36 nt direct repeat.

SEQ ID NOs: 269-272 are spacer sequences.

SEQ ID NO: 273 is a ccdB target RNA sequence.

SEQ ID NOs: 274-277 are spacer sequences.

SEQ ID NO: 278 is a gRNA sequence.

SEQ ID NO: 279 is a consensus sequence of HEPN1 domain region.

SEQ ID NO: 280-286 are HEPN1 domain regions from seven Cas13d proteins.

SEQ ID NO: 287 is a consensus sequence of HEPN2 domain region.

SEQ ID NO: 288-294 are HEPN2 domain regions from seven Cas13d proteins.

SEQ ID NO: 295 is an exemplary RNA target sequence.

SEQ ID NO: 296-309 are exemplary gRNA sequences with various truncations.

SEQ ID NO: 310 is an exemplary Cas13d protein sequence from 037_-_emb|OIZA01000315.1.

SEQ ID NO: 311 is an exemplary Cas13d protein sequence from PIG-022_GL0026351.

SEQ ID NO: 312 is an exemplary Cas13d protein sequence from PIG-046_GL0077813.

SEQ ID NO: 313 is an exemplary Cas13d protein sequence from pig_chimera.

DETAILED DESCRIPTION

Unless otherwise noted, technical terms are used according to conventional usage. Definitions of common terms in molecular biology can be found in Benjamin Lewin, *Genes VII*, published by Oxford University Press, 1999; Kendrew et al. (eds.), *The Encyclopedia of Molecular Biology*, published by Blackwell Science Ltd., 1994; and Robert A. Meyers (ed.), *Molecular Biology and Biotechnology: a Comprehensive Desk Reference*, published by VCH Publishers, Inc., 1995; and other similar references.

As used herein, the singular forms "a," "an," and "the," refer to both the singular as well as plural, unless the context clearly indicates otherwise. As used herein, the term "comprises" means "includes." Thus, "comprising a nucleic acid molecule" means "including a nucleic acid molecule" without excluding other elements. It is further to be understood that any and all base sizes given for nucleic acids are approximate, and are provided for descriptive purposes, unless otherwise indicated. Although many methods and materials similar or equivalent to those described herein can be used, particular suitable methods and materials are described below. In case of conflict, the present specification, including explanations of terms, will control. In addition, the materials, methods, and examples are illustrative only and not intended to be limiting. All references, including patent applications and patents, are herein incorporated by reference in their entireties.

In order to facilitate review of the various embodiments of the disclosure, the following explanations of specific terms are provided:

I. Terms

Administration: To provide or give a subject an agent, such as an Cas13d protein (or Cas13d coding sequence) or guide molecule (or coding sequence) disclosed herein, by any effective route. Exemplary routes of administration include, but are not limited to, injection (such as subcutaneous, intramuscular, intradermal, intraperitoneal, intratumoral, and intravenous), transdermal, intranasal, and inhalation routes.

Cas13d (also referred to as CasR, for CRISPR-associated RNase, and Cas13d ): An RNA-guided RNA endonuclease enzyme that can cut or bind RNA. Cas13d proteins include one or two HEPN domains (e.g., see SEQ ID NOS: 1-3, 42, 62, 70, 82, 83, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, and 253). Native HEPN domains include the sequence RXXXXH (SEQ ID NO: 255). Cas13d proteins that include mutated HEPN domain(s), and thus cannot cut RNA, but can process guide RNA, are also encompassed by this disclosure (e.g., see SEQ ID NOS: 2 and 4). An alignment of native Cas13d proteins is shown in FIGS. 18A-18MMM. In addition. Cas13d proteins specifically recognize direct repeat sequences of gRNA having a particular secondary structure (e.g., see FIG. 3C). In one example, Cas13d proteins recognize and/or bind a DR having (1) a loop of about 4 to 8 nt, (2) a stem of 4 to 12 nt, stem formed of complementary nucleotides, which can include a small (e.g., 1 or 2 bp) bulge due to a nt mismatch in the stem, and (3) a bulge or overhang formed of unpaired nt, which can be about 10 to 14 nt (e.g., 5 to 7 to on either side).

In one example, the full length (non-truncated) Cas13d protein is between 870-1080 amino acids long. In one example, the Cas13d protein is derived from a genome sequence of a bacterium from the Order Clostridiales or a metagenomic sequence. In one example, the corresponding DR sequence of an Cas13d protein is located at the 5' end of the spacer sequence in the molecule that includes the Cas13d gRNA. In one example, the DR sequence in the Cas13d gRNA is truncated at the 5' end relative to the DR sequence in the unprocessed Cas13d guide array transcript. In one example, the DR sequence in the Cas13d gRNA is truncated by 5-7 nt at the 5' end by the Cas13d protein. In one example, the Cas13d protein can cut a target RNA flanked at the 3' end of the spacer-target duplex by any of a A, U, G or C ribonucleotide and flanked at the 5' end by any of a A, U, G or C ribonucleotide.

In one example, an Cas13d protein has at least 80%, at least 85%, at least 90%, at least 91%, at least 92%, at least 95%, at least 96%, at least 97%, at least 98% or at least 99% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253.

In one example, an Cas13d protein contains two HEPN Rnase domains which contain a RXXXXH amino acid motif (SEQ ID NO: 255; where X indicates any amino acid). In addition, an Cas13d protein can include one or more of the following amino acid motifs written in the common Prosite format:

Motif 1: L-x(5)-[FWY]-x(3)-K-[NQS]-[ILM]-[ILMV]-x(2)-N-x(2)-[FWY]-x(2)-[AG]-x(4)-[DE]-x-D (SEQ ID NO: 195)

Motif 2: [FWY]-[ILV]-x(2)-[NQS]-[ILV]-x(2)-[DNST]-x(2)-F-x-Y-x(2)-[HKR]-[FHY] (SEQ ID NO: 196)

Motif 3: Y-[CDNSV]-x(2)-R-[FWY]-x-[ADNT]-[LM]-[ST]-x(4)-[FWY] (SEQ ID NO: 197)

Thus, in some examples, an Cas13d protein having at least 80%, at least 85%, at least 90%, at least 91%, at least 92%, at least 95%, at least 96%, at least 97%, at least 98% or at least 99% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253, includes the motif of SEQ ID NO: 195, 196 or 197.

Complementarity: The ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions.

CRISPRs (Clustered Regularly InterSpaced Repeats): The CRISPR RNA array is a defining feature of CRISPR systems. The term "CRISPR" refers to the architecture of the array which includes constant direct repeats (DRs) interspaced with the variable spacers. In some examples, a CRISPR array includes at least a DR-spacer-DR-spacer (see FIG. 1A). This feature was used in the disclosed computational pipeline to identify the novel Cas13d protein family (FIG. 1A). In bacteria, the array is transcribed as one single transcript (containing multiple crRNA units), which is then processed by the Cas13d protein and other RNases into individual crRNAs. CRISPRs are found in approximately 40% of sequenced bacteria genomes and 90% of sequenced archaea. CRISPRs are often associated with cas genes that code for proteins related to CRISPRs (such as the Cas13d proteins provided herein). The disclosed CRISPR/Cas system can be used for RNA targeting, for example to detect a target RNA, modify a target RNA at any desired location, or cut the target RNA at any desired location.

Downregulated or knocked down: When used in reference to the expression of a molecule, such as a target RNA, refers to any process which results in a decrease in production of the target RNA, but in some examples not complete elimination of the target RNA product or target RNA function. In one example, downregulation or knock down does not result in complete elimination of detectable target RNA expression or target RNA activity. In some examples, the target RNA is a coding RNA. In some examples, the target RNA is non-coding RNA. Specific examples of RNA molecules that can be targeted for downregulation include mRNA, miRNA, rRNA, tRNA, nuclear RNA, lincRNA, circular RNA, and structural RNA. In some examples, downregulation or knock down of a target RNA includes processes that decrease translation of the target RNA and thus can decrease the presence of corresponding proteins. The disclosed CRISPR/Cas system can be used to downregulate any target RNA of interest.

Downregulation or knock down includes any detectable decrease in the target RNA. In certain examples, detectable target RNA in a cell or cell free system decreases by at least 10%, at least 20%, at least 30%, at least 40%, at least 50%, at least 60%, at least 70%, at least 75%, at least 80%, at least 90%, at least 95%, at least 96%, at least 97%, at least 98%, or at least 99% (such as a decrease of 40% to 90%, 40% to 80% or 50% to 95%) as compared to a control (such an amount of target RNA detected in a corresponding normal cell or sample). In one example, a control is a relative amount of expression in a normal cell (e.g., a non-recombinant cell that does not include Cas13d or guide RNA).

Effective amount: The amount of an agent (such as the CRISPR/Cas agents provided herein) that is sufficient to effect beneficial or desired results.

A therapeutically effective amount may vary depending upon one or more of: the subject and disease condition being treated, the weight and age of the subject, the severity of the disease condition, the manner of administration and the like, which can readily be determined by one of ordinary skill in the art. The beneficial therapeutic effect can include enablement of diagnostic determinations; amelioration of a disease, symptom, disorder, or pathological condition; reducing or preventing the onset of a disease, symptom, disorder or condition; and generally counteracting a disease, symptom, disorder or pathological condition. In one embodiment, an "effective amount" is an amount sufficient to reduce symptoms of a disease, for example by at least 10%, at least 20%, at least 50%, at least 70%, or at least 90% (as compared to no administration of the therapeutic agent).

The term also applies to a dose that will allow for expression of an Cas13d and/or gRNA herein, and that allows for targeting (e.g., detection or modification) of a target RNA.

Increase or Decrease: A statistically significant positive or negative change, respectively, in quantity from a control value. An increase is a positive change, such as an increase at least 50%, at least 100%, at least 200%, at least 300%, at least 400% or at least 500% as compared to the control value. A decrease is a negative change, such as a decrease of at least 20%, at least 25%, at least 50%, at least 75%, at least 80%, at least 90%, at least 95%, at least 98%, at least 99%, or at least 100% decrease as compared to a control value. In some examples the decrease is less than 100%, such as a decrease of no more than 90%, no more than 95% or no more than 99%.

Isolated: An "isolated" biological component (such as an Cas13d protein or nucleic acid, gRNA, or cell containing such) has been substantially separated, produced apart from, or purified away from other biological components in the cell or tissue of an organism in which the component occurs, such as other cells, chromosomal and extrachromosomal DNA and RNA, and proteins. Nucleic acids and proteins that have been "isolated" include nucleic acids and proteins purified by standard purification methods. The term also embraces nucleic acids and proteins prepared by recombinant expression in a host cell as well as chemically synthesized nucleic acids and proteins. Isolated Cas13d proteins or nucleic acids, or cells containing such, in some examples are at least 50% pure, such as at least 75%, at least 80%, at least 90%, at least 95%, at least 98%, or at least 100% pure.

Label: A compound or composition that is conjugated directly or indirectly to another molecule (such as a nucleic acid molecule) to facilitate detection of that molecule. Specific, non-limiting examples of labels include fluorescent and fluorogenic moieties, chromogenic moieties, haptens, affinity tags, and radioactive isotopes. The label can be directly detectable (e.g., optically detectable) or indirectly detectable (for example, via interaction with one or more additional molecules that are in turn detectable).

Modulate: A change in the content of RNA. Modulation can include, but is not limited to, RNA activation (e.g., upregulation), RNA repression (e.g., downregulation), ribonucleotide deletion, ribonucleotide insertion, ribonucleotide chemical modification, ribonucleotide covalent or non-covalent linkage, and/or ribonucleotide substitution.

Non-naturally occurring or engineered: Terms used herein as interchangeably and indicate the involvement of the hand of man. The terms, when referring to nucleic acid molecules or polypeptides indicate that the nucleic acid molecule or the polypeptide is at least substantially free from at least one other component with which they are naturally associated in nature and as found in nature. In addition, the terms can indicate that the nucleic acid molecules or polypeptides have a sequence not found in nature.

Operably linked: A first nucleic acid sequence is operably linked with a second nucleic acid sequence when the first nucleic acid sequence is placed in a functional relationship with the second nucleic acid sequence. For instance, a promoter is operably linked to a coding sequence (such as a coding sequence of an Cas13d protein) if the promoter affects the transcription or expression of the coding sequence. Generally, operably linked DNA sequences are contiguous and, where necessary to join two protein-coding regions, in the same reading frame.

Pharmaceutically acceptable carriers: The pharmaceutically acceptable carriers useful in this invention are conventional. *Remington's Pharmaceutical Sciences*, by E. W. Martin, Mack Publishing Co., Easton, Pa., 15th Edition (1975), describes compositions and formulations suitable for pharmaceutical delivery of an Cas13d protein or nucleic acid molecule (or other molecules needed for modifying RNA using the disclosed CRISPR/Cas system with the disclosed Cas13d proteins).

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. In addition to biologically-neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate.

Polypeptide, peptide and protein: Refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics.

Promoter: An array of nucleic acid control sequences which direct transcription of a nucleic acid. A promoter includes necessary nucleic acid sequences near the start site of transcription. A promoter also optionally includes distal enhancer or repressor elements. A "constitutive promoter" is a promoter that is continuously active and is not subject to regulation by external signals or molecules. In contrast, the activity of an "inducible promoter" is regulated by an external signal or molecule (for example, a transcription factor).

Recombinant or host cell: A cell that has been genetically altered, or is capable of being genetically altered by introduction of an exogenous polynucleotide, such as a recombinant plasmid or vector. Typically, a host cell is a cell in which a vector can be propagated and its nucleic acid expressed. Such cells can be eukaryotic or prokaryotic. The term also includes any progeny of the subject host cell. It is understood that all progeny may not be identical to the parental cell since there may be mutations that occur during replication. However, such progeny are included when the term "host cell" is used.

Regulatory element: A phrase that includes promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990) which is hereby incorporated by reference in its entirety. Regulatory elements include those that direct constitutive expression of a nucleotide sequence in many types of host cells and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific.

In some embodiments, a vector provided herein includes a pol III promoter (e.g., U6 and H1 promoters), a pol II promoter (e.g., the retroviral Rous sarcoma virus (RSV) LTR promoter (optionally with the RSV enhancer), the cytomegalovirus (CMV) promoter (optionally with the CMV enhancer), the SV40 promoter, the dihydrofolate reductase promoter, the β-actin promoter, the phosphoglycerol kinase (PGK) promoter, and the EF1α promoter), or both.

Also encompassed by the term "regulatory element" are enhancer elements, such as WPRE; CMV enhancers; the R-U5' segment in LTR of HTLV-I; SV40 enhancer; and the intron sequence between exons 2 and 3 of rabbit β-globin.

RNA Editing: A type of genetic engineering in which a RNA molecule (or ribonucleotides of the RNA) is inserted, deleted or replaced in the genome of an organism using engineered nucleases (such as the Cas13d proteins provided herein), which create site-specific strand breaks at desired locations in the RNA. The induced breaks are repaired resulting in targeted mutations or repairs. The CRISPR/Cas methods disclosed herein, such as those that use an Cas13d, can be used to edit the sequence of one or more target RNAs, such as one associated with cancer (e.g., breast cancer, colon cancer, melanoma), infectious disease (such as HIV, hepatitis, HPV, and West Nile virus), or neurodegenerative disorder (e.g., Huntington's disease or ALS). For example, RNA editing can be used to treat a disease or viral infection.

RNA insertion site: A site of the RNA that is targeted for, or has undergone, insertion of an exogenous polynucleotide. The disclosed methods include use of a disclosed Cas13d protein, which can be used to target a RNA for manipulation at a RNA insertion site.

Sequence identity/similarity: The similarity between amino acid (or nucleotide) sequences is expressed in terms of the similarity between the sequences, otherwise referred to as sequence identity. Sequence identity is frequently measured in terms of percentage identity (or similarity or homology); the higher the percentage, the more similar the two sequences are.

Methods of alignment of sequences for comparison are well known in the art. Various programs and alignment algorithms are described in: Smith and Waterman, *Adv. Appl. Math.* 2:482, 1981; Needleman and Wunsch, *J. Mol. Biol.* 48:443, 1970; Pearson and Lipman, *Proc. Natl. Acad. Sci. U.S.A.* 85:2444, 1988; Higgins and Sharp, *Gene* 73:237, 1988; Higgins and Sharp, *CABIOS* 5:151, 1989; Corpet et al., *Nucleic Acids Research* 16:10881, 1988; and Pearson and Lipman, *Proc. Natl. Acad. Sci. U.S.A.* 85:2444, 1988. Altschul et al., *Nature Genet.* 6:119, 1994, presents a detailed consideration of sequence alignment methods and homology calculations.

The NCBI Basic Local Alignment Search Tool (BLAST) (Altschul et al., *J. Mol. Biol.* 215:403, 1990) is available from several sources, including the National Center for Biotechnology Information (NCBI, Bethesda, Md.) and on the internet, for use in connection with the sequence analysis programs blastp, blastn, blastx, tblastn and tblastx. A description of how to determine sequence identity using this program is available on the NCBI website on the internet.

Variants of protein and nucleic acid sequences known in the art and disclosed herein are typically characterized by possession of at least about 80%, at least 90%, at least 95%, at least 96%, at least 97%, at least 98% or at least 99% sequence identity counted over the full length alignment with the amino acid sequence using the NCBI Blast 2.0, gapped blastp set to default parameters. For comparisons of amino acid sequences of greater than about 30 amino acids, the Blast 2 sequences function is employed using the default BLOSUM62 matrix set to default parameters, (gap existence cost of 11, and a per residue gap cost of 1). When aligning short peptides (fewer than around 30 amino acids), the alignment should be performed using the Blast 2 sequences function, employing the PAM30 matrix set to default parameters (open gap 9, extension gap 1 penalties). Proteins with even greater similarity to the reference sequences will show increasing percentage identities when assessed by this method, such as at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or at least 95% depending on their similarity to the reference sequence. Methods for determining sequence identity over such short windows are available at the NCBI website on the internet. One of skill in the art will appreciate that these sequence identity ranges are provided for guidance only; it is entirely possible that strongly significant homologs could be obtained that fall outside of the ranges provided.

Thus, in one example, an Cas13d protein has at least 80%, at least 85%, at least 90%, at least 91%, at least 92%, at least 95%, at least 96%, at least 97%, at least 98% or at least 99% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 19, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253.

Subject: A vertebrate, such as a mammal, for example a human. Mammals include, but are not limited to, murines, simians, humans, farm animals, sport animals, and pets. In one embodiment, the subject is a non-human mammalian subject, such as a monkey or other non-human primate, mouse, rat, rabbit, pig, goat, sheep, dog, cat, horse, or cow. In some examples, the subject has a disorder (e.g., viral infection) or genetic disease that can be treated using methods provided herein. In some examples, the subject has a disorder (e.g., viral infection) or genetic disease that can be diagnosed using methods provided herein. In some examples, the subject is a laboratory animal/organism, such as a zebrafish, *Xenopus, C. elegans, Drosophila*, mouse, rabbit, or rat. Tissues, cells and their progeny of a biological entity obtained in vivo or cultured in vitro are also encompassed.

Therapeutic agent: Refers to one or more molecules or compounds that confer some beneficial effect upon administration to a subject. The beneficial therapeutic effect can include enablement of diagnostic determinations; amelioration of a disease, symptom, disorder, or pathological condition; reducing or preventing the onset of a disease, symptom, disorder or condition; and generally counteracting a disease, symptom, disorder or pathological condition.

Transduced, Transformed and Transfected: A virus or vector "transduces" a cell when it transfers nucleic acid molecules into a cell. A cell is "transformed" or "transfected" by a nucleic acid transduced into the cell when the nucleic acid becomes stably replicated by the cell, either by incorporation of the nucleic acid into the cellular genome, or by episomal replication.

These terms encompasses all techniques by which a nucleic acid molecule can be introduced into such a cell, including transfection with viral vectors, transformation with plasmid vectors, and introduction of naked DNA by electroporation, lipofection, particle gun acceleration and other methods in the art. In some example the method is a chemical method (e.g., calcium-phosphate transfection), physical method (e.g., electroporation, microinjection, particle bombardment), fusion (e.g., liposomes), receptor-mediated endocytosis (e.g., DNA-protein complexes, viral envelope/capsid-DNA complexes) and biological infection by viruses such as recombinant viruses (Wolff, J. A., ed, *Gene Therapeutics*, Birkhauser, Boston, USA, 1994). Methods for the introduction of nucleic acid molecules into cells are known (e.g., see U.S. Pat. No. 6,110,743). These methods can be used to transduce a cell with the disclosed agents to manipulate its genome.

Transgene: An exogenous gene.

Treating, Treatment, and Therapy: Any success or indicia of success in the attenuation or amelioration of an injury, pathology or condition, including any objective or subjective parameter such as abatement, remission, diminishing of symptoms or making the condition more tolerable to the patient, slowing in the rate of degeneration or decline, making the final point of degeneration less debilitating, improving a subject's physical or mental well-being, or prolonging the length of survival. The treatment may be assessed by objective or subjective parameters; including the results of a physical examination, blood and other clinical tests, and the like. For prophylactic benefit, the disclosed compositions may be administered to a subject at risk of developing a particular disease, condition, or symptom, or to a subject reporting one or more of the physiological symptoms of a disease, even though the disease, condition, or symptom may not have yet been manifested.

Upregulated: When used in reference to the expression of a molecule, such as a target RNA, refers to any process which results in an increase in production of the target RNA. In one example, includes direct upregulation, for example if the target RNA participates in a feedback loop with its own transcription. In one example, includes indirect upregulation, such as by knockdown of an inhibitory miRNA that leads to the activation of a target of that miRNA.

In some examples, the target RNA is a coding RNA. In some examples, the target RNA is non-coding RNA. Specific examples of RNA molecules that can be targeted for upregulation include mRNA, miRNA, rRNA, tRNA, nuclear RNA, and structural RNA. In some examples, upregulation or activation of a target RNA includes processes that increase translation of the target RNA and thus can increase the presence of corresponding proteins. The disclosed CRISPR/Cas system can be used to upregulate any target RNA of interest.

Upregulation includes any detectable increase in target RNA. In certain examples, detectable target RNA expression in a cell or cell free system (such as a cell expressing an Cas13d protein and gRNA disclosed herein) increases by at least 20%, at least 30%, at least 40%, at least 50%, at least 60%, at least 70%, at least 75%, at least 80%, at least 90%, at least 95%, at least 100%, at least 200%, at least 400%, or at least 500% as compared to a control (such an amount of target RNA detected in a corresponding normal cell or sample). In one example, a control is a relative amount of expression in a normal cell (e.g., a non-recombinant cell that does not include Cas13d or guide RNA).

Under conditions sufficient for: A phrase that is used to describe any environment that permits a desired activity. In one example the desired activity is expression of an Cas13d protein disclosed herein, in combination with other necessary elements, for example to modulate a target RNA.

Vector: A nucleic acid molecule into which a foreign nucleic acid molecule can be introduced without disrupting the ability of the vector to replicate and/or integrate in a host cell. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art.

A vector can include nucleic acid sequences that permit it to replicate in a host cell, such as an origin of replication. A vector can also include one or more selectable marker genes and other genetic elements known in the art. An integrating vector is capable of integrating itself into a host nucleic acid. An expression vector is a vector that contains the necessary regulatory sequences to allow transcription and translation of inserted gene or genes.

One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. In some embodiments, the vector is a lentivirus (such as an integration-deficient lentiviral vector) or adeno-associated viral (AAV) vector.

Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

Certain vectors are capable of directing the expression of genes to which they are operatively-linked. Such vectors are referred to herein as "expression vectors." Common expression vectors are often in the form of plasmids. Recombinant expression vectors can comprise a nucleic acid provided herein (such as a guide RNA [which can be expressed from an RNA sequence or a RNA sequence], nucleic acid encoding an Cas13d protein) in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

II. Overview of Several Embodiments

Class 2 CRISPR-Cas systems endow microbes with diverse mechanisms for adaptive immunity. Provided herein is an analysis of prokaryotic genome and metagenome sequences to identify an uncharacterized family of RNA-guided, RNA-targeting CRISPR systems which is classified as Type VI-D. Biochemical characterization and protein engineering of seven distinct orthologs generated a ribonuclease effector derived from *Ruminococcus flavefaciens* XPD3002 (CasRx) with robust activity in human cells. CasRx-mediated knockdown exhibits high efficiency and specificity relative to RNA interference across diverse endogenous transcripts. As one of the most compact single effector Cas enzymes, CasRx can also be flexibly packaged into adeno-associated virus. Virally encoded, catalytically inactive CasRx can be targeted to cis-elements of pre-mRNA to manipulate alternative splicing, alleviating dysregulated tau isoform ratios in a neuronal model of frontotemporal dementia. The results herein present CasRx as a programmable RNA-binding module for efficient targeting of cellular RNA, enabling a general platform for transcriptome engineering and therapeutic methods.

Class 2 CRISPR systems are found throughout diverse bacterial and archaeal life. Using a minimal definition of the CRISPR locus for bioinformatic mining of prokaryotic genome and metagenome sequences, which requires only a CRISPR repeat array and a nearby protein, provided herein is the identification of an uncharacterized, remarkably compact family of RNA-targeting class 2 CRISPR systems designated as Type VI CRISPR-Cas13d.

Because CRISPR systems generally exist as a functional operon within 20 kilobases of genome sequence, even fragmented metagenome reads may be sufficient to recover useful Cas enzymes for bioengineering purposes. CRISPR genome mining strategies described herein and by others (Shmakov et al., 2015), combined with ongoing efforts to profile microbial populations via next-generation sequencing, should contribute mechanistically diverse additions to the genome engineering toolbox.

Two distinct ribonuclease properties of the Cas13d effector, which processes a CRISPR repeat array into mature guides via a HEPN domain-independent mechanism followed by guide sequence-dependent recognition of a complementary activator RNA, were biochemically characterized. This triggers HEPN-mediated RNase activity, enabling Cas13d to cleave both activator and bystander RNAs, a property shared by other RNA-targeting CRISPR systems. Cas13d additionally exhibits no apparent flanking sequence requirements and was found to be active across crRNAs tiling a target RNA, suggesting the ability to target arbitrary single-stranded RNA sequences.

Figure 8A:
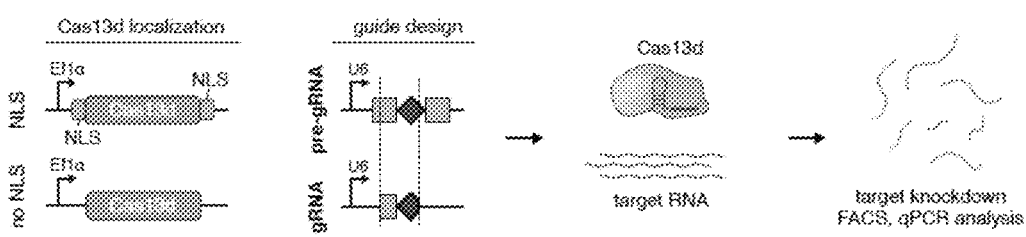
FIGS. 8A-8D: RNA knockdown activity screen of engineered Cas13d orthologs in human cells. (A) Schematic for mammalian expression constructs encoding for engineered Cas13d effectors and guides. NLS, nuclear localization signal. pre-gRNA, artificial unprocessed guide RNA containing a single 30 nt spacer sequence flanked by 2 full length 36 nt DRs. gRNA, predicted mature guide RNA with a single 30 nt processed DR and 22 nt spacer sequence (B) Heatmap of mCherry protein knockdown in a Cas13d ortholog activity screen in human HEK 293FT cells using pools of 4 pre-gRNAs or gRNAs. Normalized MFI, median fluorescent intensity relative to non-targeting condition. Positions in gray were not tested, with n=3. (C) Immunocytochemistry of Cas13d showing localization and expression of engineered constructs. Scale bar, 10 μm. Blue pseudocolor, DAPI staining of nuclei. (D) Comparison of Adm and Rfx Cas13d ortholog constructs for knockdown of endogenous B4GALNT1 mRNA reveals RfxCas13d-NLS (CasRx) to be most effective for both guide RNA architectures. Pools of 4 guides were used for targeting. NT, non-targeting. Values are mean±SEM with n=3.
Figure 8B:
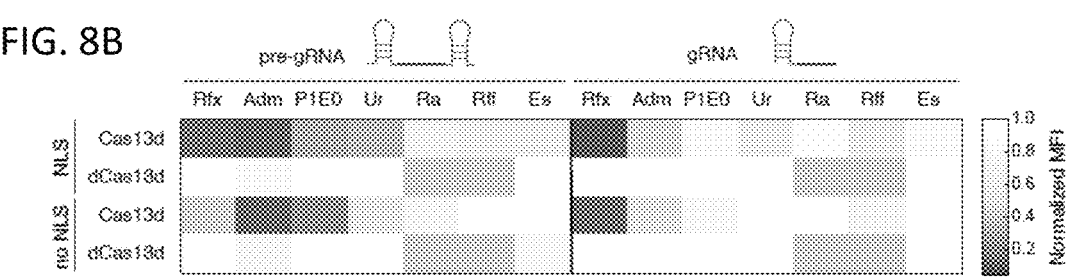
Figure 8C:
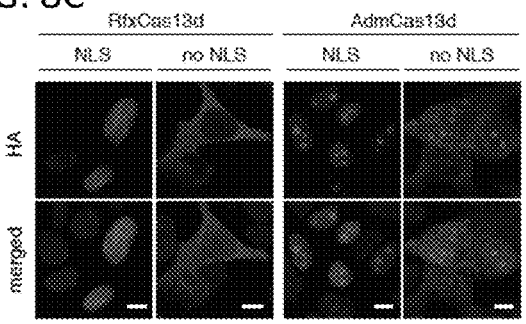
Figure 8D:
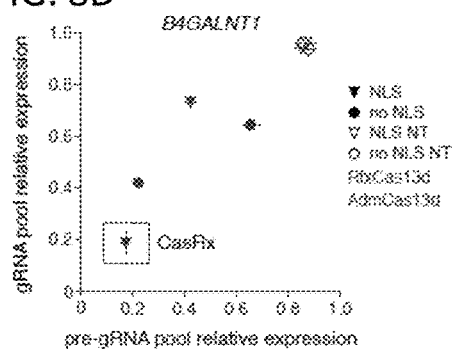

A comprehensive activity reporter screen in human cells of Cas13d orthologs sampled from distinct branches of the Cas13d family revealed that NLS fusions to Cas13d from *Ruminococcus flavefaciens* strain XPD3002 (CasRx) can be engineered for programmable RNA targeting in a eukaryotic context (FIG. 8D). CasRx fusions knocked down a diverse set of 14 endogenous mRNAs and lncRNAs, consistently achieving >90% knockdown with favorable efficiency relative to RNA interference, dCas9-mediated CRISPR interference, and other members of the Cas13 superfamily (FIGS. 10A-10C). Additionally, CasRx interference is markedly more specific than spacer-matching shRNAs, with no detectable off-target changes compared with hundreds for RNA interference.

CasRx is a minimal two-component platform, including an engineered CRISPR-Cas13d effector and an associated guide RNA, and can be fully genetically encoded. Because CasRx is an orthogonally delivered protein, HEPN-inactive dCasRx can be engineered as a flexible RNA-binding module to target specific RNA elements. Importantly, because CasRx uses a distinct ribonuclease activity to process guide RNAs, dCasRx can still be paired with a repeat array for multiplexing applications. The utility of this concept is shown herein by creating a dCasRx splice effector fusion for tuning alternative splicing and resulting protein isoform ratios, applying it in a neuronal model of frontotemporal dementia.

At an average size of 930 aa, Cas13d is the smallest class 2 CRISPR effector characterized in mammalian cells. This allows CasRx effector domain fusions to be paired with a CRISPR array encoding multiple guide RNAs while remaining under the packaging size limit of the versatile adeno-associated virus (AAV) delivery vehicle (Naldini, 2015) for primary cell and in vivo delivery. Further, targeted AAV delivery of CasRx to specific postmitotic cell types such as neurons can mediate long-term expression of a corrective payload that avoids permanent genetic modifications or frequent re-administration (Chiriboga et al., 2016), complementing other nucleic acid targeting technologies such as DNA nuclease editing or antisense oligonucleotides. RNA mis-splicing diseases have been estimated to account for up to 15% of genetic diseases (Hammond and Wood, 2011), highlighting the potential for engineered splice effectors capable of multiplexed targeting. The materials provided herein can be used for RNA targeting for knockdown and splicing, such as live cell labeling and genetic screens to transcript imaging, trafficking, or regulation. CRISPR-Cas13d and engineered variants such as CasRx collectively enable flexible nucleic acid engineering, transcriptome-related study, and therapeutics, expanding the genome editing toolbox beyond DNA to RNA.

Provided herein are methods of targeting (e.g., modifying, detecting) one or more target RNA molecules, such as a clustered regularly interspaced short palindromic repeats (CRISPR)-CRISPR associated (Cas) system-mediated RNA editing method. Such methods can include contacting one or more target RNA molecules with a non-naturally occurring or engineered (e.g., does not naturally occur in the cell or system into which it is introduced) CRISPR-Cas system. Thus in some examples, the disclosed CRISPR-Cas system includes a naturally occurring Cas13d protein (or coding sequence) and a naturally occurring gRNA, but is used in a system or cell in which the Cas1 protein (or coding sequence) and the gRNA are not naturally found. Furthermore, the spacer sequence within the gRNA molecule is not naturally occurring, and has been modified to be complementary to the target RNA molecule.

In some examples, a target RNA is a coding RNA. In some examples, the RNA is non-coding RNA.

The disclosed CRISPR-Cas system can include (1) at least one Cas13d protein or at least one Cas13d nucleic acid coding sequence (such as a mRNA or a vector encoding the at least one Cas13d protein) and (2) at least one CRISPR-Cas system guide nucleic acid molecule (e.g., gRNA) (or at least one nucleic acid molecule encoding the gRNA) having sufficient complementary to a target RNA such that it can hybridize to a target RNA molecule. The Cas13d protein forms a complex with the gRNA, and the gRNA directs the complex to the one or more target RNA molecules. This targeting can allow the Cas13d-gRNA complex to modify or detect the one or more target RNA molecules. In some examples, the one or more target RNA molecules (or a cell containing the one or more target RNA molecules) are contacted with a complex comprising the at least one Cas13d protein and the at least one gRNA. In some examples, the system includes $Mg^{2+}$. However, in some examples, the system does not require $Mg^{2+}$, such as if cleavage of the target RNA is not desired.

In some examples, contacting the one or more target RNA molecules with the non-naturally occurring or engineered CRISPR-Cas system includes introducing into a cell (such as a eukaryotic or prokaryotic cell) containing the one or more target RNA molecules the non-naturally occurring or engineered CRISPR-Cas system, for example using endocytosis (e.g., receptor-mediated endocytosis, micropinocytosis), a liposome, a particle, an exosome, a microvesicle, a gene gun, electroporation, a virus, RNP-antibody fusion (e.g., by tethering an Cas13d RNP to an antibody, antibody fragment, or other targeting moiety [such as ScFv, aptamers, DARPins, nanobodies, affibodies, etc.], the RNP can be endocytosed into the cell, The RNP could conceivably be tethered to many things other than), or combinations thereof. Thus, cells can be transformed, transduced, transfected, or otherwise contacted with appropriate nucleic acid molecules of the disclosed CRISPR-Cas system. The resulting cells are recombinant cells. In some examples, contacting the one or more target RNA molecules with the non-naturally occurring or engineered CRISPR-Cas system includes contacting a cell-free system (such as a biological or environmental sample, or a cell lysate) containing the one or more target RNA molecules the non-naturally occurring or engineered CRISPR-Cas system (for example in a diagnostic method to detect a target RNA).

In some examples, at least 2, at least 3, at least 4, at least 5, at least 10, or at least 20 different gRNAs are used. For example, such a method could include targeting at least 2, at least 3, at least 4, at least 5, at least 10, or at least 20 different target RNA molecules, targeting at least 2, at least 3, at least 4, at least 5, at least 10, or at least 20 different regions of one or more RNA molecules, or combinations thereof.

Also provided are isolated nucleic acid molecules encoding such Cas13d proteins, such as a cDNA, genomic DNA, RNA, or mDNA. Such isolated nucleic acid molecules can be part of a vector (such as a plasmid or viral vector), and can be operably linked to a promoter. In some examples, an isolated nucleic acid molecule encoding a Cas13d protein has at least 80%, at least 85%, at least 90%, at least 92%, at least 95%, at least 96%, at least 97%, at least 98%, at least 99%, or 100% sequence identity to SEQ ID NO: 124, 125, 126, 127, 128, 139, 140 or 141; or at least 80%, at least 85%, at least 90%, at least 92%, at least 95%, at least 96%, at least 97%, at least 98%, at least 99%, or 100% sequence identity to SEQ ID NO: 114, 115, 116, 117, 118, 119, 120, 121, 122, 123, 142, 143, 144, or 145. In an additional example, an isolated nucleic acid encodes a Cas13d protein having at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253.

In some examples, an isolated nucleic acid molecule encoding at least one Cas13d protein (which can be part of a vector) includes at least one Cas13d protein coding sequence that is codon optimized for expression in a eukaryotic cell, at least one Cas13d protein coding sequence codon optimized for expression in a human cell. In one example, such an Cas13d coding sequence has at least 80%, at least 85%, at least 90%, at least 92%, at least 95%, at least 96%, at least 97%, at least 98%, at least 99%, or 100% sequence identity to SEQ ID NO: 114, 115, 116, 117, 118, 119, 120, 121, 122, 123, 142, 143, 144, or 145, or has at least 80%, at least 85%, at least 90%, at least 92%, at least 95%, at least 96%, at least 97%, at least 98%, at least 99%, or 100% sequence identity to SEQ ID NO: 124, 125, 126, 127, 128, 139, 140 or 141. In an additional example, a eukaryotic cell codon optimized nucleic acid sequence encodes a Cas13d protein having at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253.

In some examples, the gRNA that hybridizes with the one or more target RNA molecules includes one or more direct repeat (DR) sequences, one or more spacer sequences, or one or more sequences comprising DR-spacer-DR-spacer. In some examples, the one or more DR sequences have at least 80%, at least 85%, at least 90%, at least 92%, at least 95%, at least 96%, at least 97%, at least 98%, at least 99%, or 100% sequence identity to SEQ ID NO: 129, 130, 131, 132, 133, 134, 135, 136, 137, 148, 150, 151, 152, 154, 156, 157, 159, 161, 163, 165, 167, 169, 176, 178, 180, 182, 184, 186, 188, 190, 191, 192, 193, 199, 201, 203, 205, 207, 209, 211, 213, 215, 217, 219, 221, 223, 225, 227, 228, 230, 232, 234, 236, 238, 240, 242, 244, 246, 248, 250, 252, or 254. In one example, the gRNA includes additional sequences, such as an aptamer sequence.

In some examples, a plurality of gRNAs are processed from a single array transcript, wherein each gRNA can be different, for example to target different RNAs or target multiple regions of a single RNA.

In some examples, the DRs are truncated by 1-10 nucleotides (such as 1, 2, 3, 4, 5, 6, 7, 8, 9, or 10 nucleotides) at the 5'end, for example to be expressed as mature pre-processed guide RNAs.

Methods of targeting one or more target RNA molecules are provided. Targeting an RNA molecule can include one or more of cutting or nicking one or more target RNA molecules, activating or upregulating one or more target RNA molecules, activating or suppressing translation the one or more target RNA molecules, deactivating the one or more target RNA molecules, visualizing, labeling, or detecting the one or more target RNA molecules, binding the one or more target RNA molecules, editing the one or more target RNA molecules, trafficking the one or more target RNA molecules, and masking the one or more target RNA molecules. In some example, modifying one or more target RNA molecules includes one or more of an RNA base substitution, an RNA base deletion, an RNA base insertion, a break in the target RNA, methylating RNA, and demethylating RNA.

In some examples, such methods are used to treat a disease, such as a disease in a human. In such examples, the one or more target RNA molecules is associated with the disease Also provided are isolated proteins, including non-naturally occurring proteins. in some examples, a protein has at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253. In some examples, an isolated protein is an Cas13d ortholog from a prokaryotic genome or metagenome, gut metagenome, an activated sludge metagenome, an anaerobic digester metagenome, a chicken gut metagenome, a human gut metagenome, a pig gut metagenome, a bovine gut metagenome, a sheep gut metagenome, a goat gut metagenome, a capybara gut metagenome, a primate gut metagenome, a termite gut metagenome, a fecal metagenome, a genome from the Order Clostridiales, or the Family Ruminococcaceae. In some examples, an Cas13d ortholog includes an Cas13d ortholog from *Ruminococcus albus, Eubacterium siraeum*, a *Ruminococcus flavefaciens* strain XPD3002, *Ruminococcus flavefaciens* FD-1, uncultured *Eubacterium* sp TS28-c4095, uncultured *Ruminococcus* sp., *Ruminococcus bicirculans*, or *Ruminococcus* sp CAG57. Such proteins can include a subcellular localization signal. In some examples, such proteins include a mutation in at least one native HEPN domain.

Also provided are isolated guide RNA (gRNA) molecules. In some examples, an isolated gRNA includes one or more direct repeat (DR) sequences, such as one having at least 80%, at least 85%, at least 90%, at least 92%, at least 95%, at least 96%, at least 97%, at least 98%, at least 99%, or 100% sequence identity to SEQ ID NO: 129, 130, 131, 132, 133, 134, 135, 136, 137, 148, 150, 151, 152, 154, 156, 157, 159, 161, 163, 165, 167, 169, 176, 178, 180, 182, 184, 186, 188, 190, 191, 192, 193, 199, 201, 203, 205, 207, 209, 211, 213, 215, 217, 219, 221, 223, 225, 227, 228, 230, 232, 234, 236, 238, 240, 242, 244, 246, 248, 250, 252, or 254. Such a gRNA can further include one or more spacer sequences specific for (e.g., is complementary to) the target RNA. Such guide RNAs can further be optionally truncated by 1-10 nucleotides (such as 1, 2, 3, 4, 5, 6, 7, 8, 9, or 10 nucleotides) at the 5'end of the DR, for example to generate pre-processed guide RNAs.

Also provided are ribonucleoprotein (RNP) complexes, which include one or more Cas13d proteins provided herein and one or more gRNAs provided herein.

Also provided are recombinant cells that include any Cas13d protein (or nucleic acid molecule encoding Cas13d), any gRNA, any RNP complex, or any vector, provided herein. In one example, the cell is not a bacterial cell. In one example, the cell is a bacterial cell.

Also provided are compositions that include one or more of any Cas13d protein (or nucleic acid molecule encoding Cas13d), any gRNA or array, any RNP complex, any isolated nucleic acid molecule, any vector, or any cell, provided herein. Such compositions can include a pharmaceutically acceptable carrier.

Also provided are kits. Such kits can include one or more of any Cas13d protein (or nucleic acid molecule encoding Cas13d), any gRNA or array, any RNP complex, any isolated nucleic acid molecule, any vector, any cell, or any composition provided herein. Such reagents can be combined or in separate containers.

In some examples, a Cas13d protein is programmed toward its RNA target by combining the protein (or nucleic acid encoding the protein) with an engineered RNA guide (or nucleic acid encoding RNA guide) consisting of a full or partial direct repeat sequence followed by a "spacer" sequence complementary to the RNA target(s) (or variations thereof, i.e. arrays (DR-spacer-DR-spacer-DR-spacer.etc.) or pre-guide RNAs (DR-spacer-DR). Cas13d Proteins can be catalytically inactivated and transformed into RNA binding modules by mutating the conserved RNAse HEPN motif (RXXXXH). Exemplary Cas13d proteins and corresponding guides are provided herein (e.g., SEQ ID NOS: 147-170, 175-193 and SEQ ID NOS: 198-254).

A. Cas13d Proteins

Provided herein are novel Cas13d proteins, such as those as shown in in the sequence listing. SEQ ID NOS: 1, 3, 42, 62, 70, 82, 83, 92, 147, 149, 153, 155, 158, 160, 162, 164, 166, 168, 170, 175, 177, 179, 181, 183, 185, 187, 189, 198, 200, 202, 204, 206, 208, 210, 212, 214, 216, 218, 220, 222, 224, 226, 229, 231, 233, 235, 237, 239, 241, 243, 245, 247, 249, 251, and 253 provide distinct full length proteins, and SEQ ID NOS: 2, 4-41, 43-61, 63-69, 71-81, 84-91, and 93-113 and 194 provide Cas13d variants and fragments. Such proteins can be used in the disclosed methods, compositions, and kits.

In some examples, an Cas13d protein includes one or more (such as 1 or 2) native HEPN domains. In some examples, an Cas13d protein includes one or more mutated HEPN domains (such as mutant Cas13d protein can process the gRNA, but cannot modify the target RNA). In some examples, an Cas13d protein is no more than 150 kD, no more than 140 kD, no more than 130 kD, no more than 120 kD, such as about 90 to 120 kD, about 100 to 120 kD or about 110 kD.

In addition to the Cas13d proteins provided in Table 1 and in Example 2, the disclosure encompasses Cas13d orthologs from a prokaryotic genome or metagenome, gut metagenome, an activated sludge metagenome, an anaerobic digester metagenome, a chicken gut metagenome, a human gut metagenome, a pig gut metagenome, a bovine gut metagenome, a sheep gut metagenome, a goat gut metagenome, a capybara gut metagenome, a primate gut metagenome, a termite gut metagenome, a fecal metagenome, a genome from the Order Clostridiales, or the Family Ruminococcaceae, such as an Cas13d ortholog from *Ruminococcus albus*, *Eubacterium siraeum*, a *Ruminococcus flavefaciens* strain XPD3002, *Ruminococcus flavefaciens* FD-1, uncultured *Eubacterium* sp TS28-c4095, uncultured *Ruminococcus* sp., *Ruminococcus bicirculans*, or *Ruminococcus* sp CAG57.

In some examples, an Cas13d protein is at least 800 aa, at least 900 aa, or at least 1000 aa, such as 800 to 1200 aa, 850 to 1050 aa, or 860-1040 aa.

1. Variant Cas13d Sequences

Cas13d proteins, including variants of the sequences provided herein (such as variants of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) are encompassed within this disclosure. In some examples, Cas13d proteins provided herein can contain one or more mutations, such as a single insertion, a single deletion, a single substitution, or combinations thereof. In some examples, the Cas13d protein includes at least 1, at least 5, at least 10, at least 15, at least 20, at least 25, at least 30, at least 40, at least 50, at least 75, at least 100, at least 200 or at least 300 aa insertions, such as 1-20 insertions (for example at the N- or C-terminus or within the protein, such as insertion of a whole small domain), at least 1, at least 5, at least 10, at least 15, at least 20, at least 25, at least 30, at least 40, at least 50, at least 75, at least 100, at least 200 or at least 300 aa deletions (such as deletion of a whole small domain), such as 1-20 deletions (for example at the N- or C-terminus or within the protein), at least 1, at least 5, at least 10, at least 15, at least 20, at least 25, at least 30 aa substitutions, such as 1-20 substitutions, or any combination thereof (e.g., single insertion together with 1-19 substitutions), but retain the ability to bind target RNA molecules complementary to the spacer sequence within the gRNA molecule and/or process an guide array RNA transcript into gRNA molecules and/or retain the ability to cleave target RNA. In some examples, the disclosure provides a variant of any disclosed Cas13d protein (such as SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) having 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acid changes, but retain the ability to bind target RNA molecules complementary to the spacer sequence within the gRNA molecule and/or process an guide array RNA transcript into gRNA molecules. In some examples, any disclosed Cas13d protein (such as SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) further includes 1-8 amino acid insertions, 1-15 amino acid deletions, 1-10 amino acid substitutions, or any combination thereof (e.g., 1-15, 1-4, or 1-5 amino acid deletions together with 1-10, 1-5 or 1-7 amino acid substitutions), with the retained ability to bind target RNA molecules complementary to the spacer sequence within the gRNA molecule and/or process an guide array RNA transcript into gRNA molecules. In one example, such variant peptides are produced by manipulating the nucleotide sequence encoding a peptide using standard procedures such as site-directed mutagenesis or PCR. Such variants can also be chemically synthesized.

In some examples, an Cas13d protein includes a motif shown in SEQ ID NO: 195, 196 or 197. Thus, an Cas13d protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253, in some examples includes at least one motif shown in SEQ ID NO: 195, 196 or 197.

One type of modification or mutation includes the substitution of amino acids for amino acid residues having a similar biochemical property, that is, a conservative substitution (such as 1-4, 1-8, 1-10, or 1-20 conservative substitutions). Typically, conservative substitutions have little to no impact on the activity of a resulting peptide. For example, a conservative substitution is an amino acid substitution in an Cas13d protein (such as SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) that does not substantially affect the ability of the Cas13d protein to bind target RNA molecules complementary to the spacer sequence within the gRNA molecule and/or process an guide array RNA transcript into gRNA molecules. An alanine scan can be used to identify which amino acid residues in an Cas13d protein (such as SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253), can tolerate an amino acid substitution. In one example, the ability of a variant Cas13d protein (such as 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) to modify gene expression in a CRISPR/Cas system, is not altered by more than 25%, for example not more than 20%, for example not more than 10%, when an alanine, or other conservative amino acid, is substituted for 1-4, 1-8, 1-10, or 1-20 native amino acids. Examples of amino acids which may be substituted for an original amino acid in a protein and which are regarded as conservative substitutions include: Ser for Ala; Lys for Arg; Gln or His for Asn; Glu for Asp; Ser for Cys; Asn for Gln; Asp for Glu; Pro for Gly; Asn or Gln for His; Leu or Val for Ile; Ile or Val for Leu; Arg or Gln for Lys; Leu or Ile for Met; Met, Leu or Tyr for Phe; Thr for Ser; Ser for Thr; Tyr for Trp; Trp or Phe for Tyr; and Ile or Leu for Val.

One method for identifying regions particularly amenable to insertions, substitutions or deletion is to target stretches of amino acids exhibiting low levels of conservation between orthologs. Such regions are indicated in the conservation graph of the alignment of Cas13d proteins provided in FIG. 1B. Conserved residues of Cas13d are further marked in the Cas13d protein alignment provided in FIG. 18A-18MMM (indicated by symbols "." ":" or "*" below aligned conserved residues). Examples of deletions and their functional testing are further provided in FIGS. 16A-16B.

Another type of substitution can be achieved by swapping out parts of one ortholog with the homologous region of another ortholog to obtain a combined "chimeric" protein. Such a chimeric protein may combine favorable properties of multiple Cas13d orthologs.

More substantial changes can be made by using substitutions that are less conservative, e.g., selecting residues that differ more significantly in their effect on maintaining: (a) the structure of the polypeptide backbone in the area of the substitution, for example, as a sheet or helical conformation; (b) the charge or hydrophobicity of the polypeptide at the target site; or (c) the bulk of the side chain. The substitutions that in general are expected to produce the greatest changes in polypeptide function are those in which: (a) a hydrophilic residue, e.g., serine or threonine, is substituted for (or by) a hydrophobic residue, e.g., leucine, isoleucine, phenylalanine, valine or alanine; (b) a cysteine or proline is substituted for (or by) any other residue; (c) a residue having an electropositive side chain, e.g., lysine, arginine, or histidine, is substituted for (or by) an electronegative residue, e.g., glutamic acid or aspartic acid; or (d) a residue having a bulky side chain, e.g., phenylalanine, is substituted for (or by) one not having a side chain, e.g., glycine.

Thus, the disclosure provides Cas13d proteins having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253 or combinations (e.g., chimeras) thereof.

In one example, an Cas13d protein includes non-naturally occurring amino acids.

2. Cas13d Proteins with Other Elements

An Cas13d protein (such as any of SEQ ID NOS: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) can include other elements or domains, for example at the N- or C-terminus (or both). The resulting protein can be referred to as an Cas13d fusion protein. In one example, an Cas13d protein provided herein (such as a native Cas13d or an Cas13d with mutated HEPN domain(s)) includes a subcellular localization signal. Exemplary subcellular localization signals include an organelle localization signal, such as a nuclear localization signal (NLS), nuclear export signal (NES), or mitochondrial localization signal. In one example, an Cas13d protein includes an NLS, such as SPKKKRKVEAS (SEQ ID NO: 256; e.g., encoded by AGCCCCAAGAAgAAGAGaAAGGTGGAGGCCAGC, SEQ ID NO: 257) or GPKKKRKVAAA (SV40 large T antigen NLS, SEQ ID NO: 258; e.g., encoded by ggacctaagaaaaagaggaaggtggcggccgct, SEQ ID NO: 260). Exemplary NES that can be part of an Cas13d protein include an adenovirus type 5 E1B nuclear export sequence, an HIV nuclear export sequence, a MAPK nuclear export sequence, or a PTK2 nuclear export sequence.

In some examples, the at least one Cas13d protein (such as a native Cas13d or an Cas13d with mutated HEPN domain(s)) further includes one or more effector domains. Exemplary effector domains include proteins and/or enzymes, such that those can cleave RNA (e.g., a PIN endonuclease domain, an NYN domain, an SMR domain from SOT1, or an RNase domain from Staphylococcal nuclease), those that can affect RNA stability (e.g., tristetraprolin (TTP) or domains from UPF1, EXOSC5, and STAU1), those that can edit a nucleotide or ribonucleotide (e.g., a cytidine deaminase, PPR protein, adenosine deaminase, ADAR family protein, or APOBEC family protein), those that can activate translation (e.g., eIF4E and other translation initiation factors, a domain of the yeast poly(A)-binding protein or GLD2), those that can repress translation (e.g., Pumilio or FBF PUF proteins, deadenylases, CAF1, Argonaute proteins), those that can methylate RNA (e.g., domains from m6A methyltransferase factors such as METTL14, METTL3, or WTAP), those that can demethylate RNA (e.g., human alkylation repair homolog 5 or Alkbh5), those that can affect splicing (e.g., the RS-rich domain of SRSF1, the Gly-rich domain of hnRNP A1, the alanine-rich motif of RBM4, or the proline-rich motif of DAZAP1), those that can enable affinity purification or immunoprecipitation (e.g., FLAG, HA, biotin, or HALO tags), and those that can enable proximity-based protein labeling and identification (e.g., a biotin ligase (such as BirA) or a peroxidase (such as APEX2) in order to biotinylate proteins that interact with the target RNA).

In some examples, the Cas13d protein and effector module combination can constitute a transcriptional sensor. For example, the transcriptional sensor can be comprised of at least one Cas13d protein with a mutated HEPN domain (e.g., SEQ ID NO: 2 or 4), at least one gRNA containing at least one spacer sequence specific for the target RNA, and an effector module such as an optionally split fluorescent protein or probe (e.g., a split Venus fluorescent protein, a split GFP, a split enhanced GFP, a split mCherry, a split super-folder mCherry, and other fluorescent protein variants such as ECFP, YFP, RFP, and derivatives or fragments thereof); an optionally split luminescent protein or probe (e.g. Gaussia, Firefly, NanoLuc, or Renilla variants); an optionally split enzyme (e.g., ubiquitin or TEV protease); a FRET-compatible protein pair; one or more transcription factor(s) fused to Cas13d via cleavable linkers (e.g., an artificial GAL4, zinc finger, transcriptional activator like effector (TALE), CRISPR-Cas9, CRISPR-Cpf1, or TetR-based transcription factor or an endogenous transcription factor); a split intein that trans-splices a protein to restore its function such as a transcription factor (e.g., an intein from *Rhodothermus marinus* or DnaE); a kinase-substrate pair that activates upon phosphorylation (e.g., TYK2-STAT3); one, two, or more monomers that activate upon dimerization or multimerization (e.g., caspase 9); or one or more proteins that induce conformational and functional change upon interaction. In one example, the spatial proximity of two or more Cas13d proteins and gRNAs due to binding a particular transcript would activate the effector module, resulting in a detectable signal or detectable activity in the cell.

In one example, the effector domain is fused to a protein that specifically recognizes and binds an RNA aptamer, such as one that can be appended to or inserted within a gRNA molecule (e.g., an MS2, PP7, Qβ, and other aptamers). This aptamer-effector domain fusion can be used to target the target RNA because the Cas13d and gRNA complex will guide the aptamer protein-effector domain in proximity to the target RNA.

In another example, the aptamer can be directly inserted into the gRNA molecule to permit detection of a target RNA, such as a fluorophore aptamer (e.g., Spinach, Mango, etc.).

In some examples, the Cas13d protein (such as a native Cas13d or an Cas13d with mutated HEPN domain(s)) includes a purification tag, such as an HA-tag, His-tag (such as 6-His), Myc-tag, E-tag, S-tag, calmodulin tag, FLAG-tag, GST-tag, MBP-tag, and the like. Such tags are in some examples at the N- or C-terminal end of the Cas13d protein.

In some examples, an Cas13d protein (such as a native Cas13d or an Cas13d with mutated HEPN domain(s)) includes one or more subcellular localization signals, effector domains, and purification tags.

In some examples, an Cas13d protein may be split into multiple fragments, which are then expressed individually. Such fragments of Cas13d may be optionally fused to other protein domains. In one example, an Cas13d can be split into two halves, which are then fused to two parts of an inducible heterodimer pair. Upon induction of heterodimer binding, the Cas13d halves are recruited to each other to form an active protein. Such a system would allow for the inducible control of Cas13d activity. Useful heterodimer pairs include two proteins that dimerize upon light illumination or through administration of a small molecule compound, amongst others. Specific examples of heterodimer pair include but are not limited to: light inducible Magnets proteins, the light inducible iLID-SspB pair, the light inducible Cryptochrome2-CIB1 dimer and the small molecule inducible FKBP protein. In another example of a split Cas13d design, two halved of the Cas13d protein may be fused to protein trans-splicing domains. Such a design would enable the separate expression of two halves which are reconstituted into a full length protein once expressed inside a cell. An example of such transsplicing domains includes the Intein system.

One method for identifying regions particularly amenable to splitting of the protein, is to identify stretches of amino acids exhibiting low levels of conservation between orthologs. Such regions are indicated in the conservation graph of the alignment of Cas13d proteins provided in FIG. 1B. Regions of conserved residues of Cas13d are further marked in the Cas13d protein alignment provided in FIG. 18A-18MMM (indicated by symbols . : or * below aligned conserved residues).

3. Generation of Cas13d Proteins

In one example, the Cas13d protein is expressed in vitro, for example, in a prokaryotic cell (e.g., bacteria such as *Lactobacillus, Lactococcus, Bacillus* (such as *B. subtilis*), *Escherichia* (such as *E. coli*), *Salmonella typhimurium*, and *Clostridium*), archea cell, plant or plant cell, fungal cell (e.g., *Neurospora*), yeast cell (e.g., *Saccharomyces* or *Pichia* (such as *S. cerevisiae* or *P. pastoris*), *Kluyveromyces lactis*), insect cell (e.g., SF9 cells), or mammalian cells (e.g., 293 cells, or immortalized mammalian myeloid and lymphoid cell lines). Once expressed, the Cas13d protein can be isolated and/or purified (e.g., using chromatography or immunological separation). In some examples, as tag on the Cas13d protein permits isolation of the protein from a culture media. Exemplary procedures include ammonium sulfate precipitation, affinity columns, column chromatography, and the like (see, generally, R. Scopes, *Protein Purification*, Springer-Verlag, N.Y., 1982). Substantially pure compositions of at least about 90 to 95% homogeneity, such as 98% to 99% homogeneity, can be used in the methods provided herein. For example, a purified preparation of an Cas13d protein can be used as an alternative to expressing the Cas13d protein from a nucleic acid molecule in the CRISPR/Cas system.

In addition to recombinant methods, Cas13d proteins disclosed herein can also be constructed in whole or in part using native chemical ligation and/or expressed protein ligation.

B. Nucleic Acid Molecules Encoding Cas13d Proteins

Nucleic acid molecules encoding an Cas13d protein are encompassed by this disclosure. Nucleic acid molecules include DNA, genomic DNA, cDNA, mRNA, and RNA sequences which encode an Cas13d peptide. Such nucleic acid molecules can include naturally occurring or non-naturally occurring nucleotides or ribonucleotides. Exemplary nucleic acid molecules that encode the novel Cas13d proteins shown in SEQ ID NOS: 1, 3, 42, 62, 70, 82, 83, 92 and 104, are shown in SEQ ID NOS: 124-128, 139, 140, and 141. Also provided are codon optimized nucleic acid molecules that encode the novel Cas13d proteins, for example those optimized for expression in a mammalian cells, such as a human cell (SEQ ID NOS: 114-123 and 142-145). For example, SEQ ID NOS: 114, 118, and 122 provide nucleic acid molecules optimized for expression in human cells. SEQ ID NOS: 115, 119 and 123 provide nucleic acid molecules optimized for expression in human cells, and which encode for mutant HEPN sites. SEQ ID NOS: 116 and 120 provide nucleic acid molecules optimized for expression in human cells, and which includes an N-terminal nuclear localization (NLS) coding sequence (namely, SPKKKRK-VEAS). SEQ ID NO: 117 and 121 provide nucleic acid molecules optimized for expression in human cells, and which include N-terminal and C-terminal NLS coding sequences (namely, SPKKKRKVEAS, SEQ ID NO: 256, and GPKKKRKVAAA SEQ ID NO: 258, respectively).

In one example, a nucleic acid sequence encodes an Cas13d protein having at least 60%, at least 70%, at least 75%, at least 80%, at least 90%, at least 92%, at least 95%, at least 96%, at least 97%, at least 99% or at least 99% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253. Such nucleic acid sequences can be generated based on the amino acid sequences provided herein, and the genetic code. In one example, an Cas13d nucleic acid sequence has at least 70%, at least 80%, at least 85%, at least 90%, at least 92%, at least 95%, at least 98%, or at least 99% sequence identity to SEQ ID NO: 124, 125, 126, 127, 128, 139, 140 or 141. In one example, an Cas13d nucleic acid sequence is optimized for expression in mammalian cells, such as human cells, such as one having at least 70%, at least 80%, at least 85%, at least 90%, at least 92%, at least 95%, at least 98%, or at least 99% sequence identity to SEQ ID NO: 114, 115, 116, 117, 118, 119, 120, 121, 122, 123, 142, 143, 144, or 145.

One of skill can readily construct a variety of clones containing functionally equivalent nucleic acids, such as nucleic acids which differ in sequence but which encode the same Cas13d protein sequence. Silent mutations in the coding sequence result from the degeneracy (i.e., redundancy) of the genetic code, whereby more than one codon can encode the same amino acid residue. Thus, for example, leucine can be encoded by CTT, CTC, CTA, CTG, TTA, or TTG; serine can be encoded by TCT, TCC, TCA, TCG, AGT, or AGC; asparagine can be encoded by AAT or AAC; aspartic acid can be encoded by GAT or GAC; cysteine can be encoded by TGT or TGC; alanine can be encoded by GCT, GCC, GCA, or GCG; glutamine can be encoded by CAA or CAG; tyrosine can be encoded by TAT or TAC; and isoleucine can be encoded by ATT, ATC, or ATA. Tables showing the standard genetic code can be found in various sources (see, for example, Stryer, 1988, Biochemistry, 3$^{rd}$ Edition, W.H. 5 Freeman and Co., NY).

Based on the genetic code, nucleic acid sequences coding for any Cas13d sequence can be generated. In some examples, such a sequence is optimized for expression in a host or target cell, such as a host cell used to express the Cas13d protein or a cell in which the disclosed methods are practice (such as in a mammalian cell, such as a human cell). Codon preferences and codon usage tables for a particular species can be used to engineer isolated nucleic acid molecules encoding an Cas13d (such as one encoding a protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253 that takes advantage of the codon usage preferences of that particular species). For example, the Cas13d proteins disclosed herein can be designed to have codons that are preferentially used by a particular organism of interest. In one example, an Cas13d nucleic acid sequence is optimized for expression in human cells, such as one having at least 70%, at least 80%, at least 85%, at least 90%, at least 92%, at least 95%, at least 98%, or at least 99% sequence identity to SEQ ID NO: 114, 115, 116, 117, 118, 119, 120, 121, 122, 123, 142, 143, 144, or 145.

A nucleic acid encoding an Cas13d protein (such as one encoding a protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) can be cloned or amplified by in vitro methods, such as the polymerase chain reaction (PCR), the ligase chain reaction (LCR), the transcription-based amplification system (TAS), the self-sustained sequence replication system (3SR) and the Qβ replicase amplification system (QB). In addition, nucleic acids encoding an Cas13d protein (such as one encoding a protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) can be prepared by cloning techniques. Examples of appropriate cloning and sequencing techniques, and instructions sufficient to direct persons of skill through cloning are found in Sambrook et al. (ed.), Molecular Cloning: A Laboratory Manual 2nd ed., vol. 1-3, Cold Spring Harbor Laboratory Press, Cold Spring, Harbor, N.Y., 1989, and Ausubel et al., (1987) in "Current Protocols in Molecular Biology," John Wiley and Sons, New York, N.Y.

Nucleic acid sequences encoding an Cas13d protein (such as one encoding a protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) can be prepared by any suitable method including, for example, cloning of appropriate sequences or by direct chemical synthesis by methods such as the phosphotriester method of Narang et al., *Meth. Enzymol.* 68:90-99, 1979; the phosphodiester method of Brown et al., *Meth. Enzymol.* 68:109-151, 1979; the diethylphosphoramidite method of Beaucage et al., *Tetra. Lett.* 22:1859-1862, 1981; the solid phase phosphoramidite triester method described by Beaucage & Caruthers, *Tetra. Letts.* 22(20):1859-1862, 1981, for example, using an automated synthesizer as described in, for example, Needham-VanDevanter et al., *Nucl. Acids Res.* 12:6159-6168, 1984; and, the solid support method of U.S. Pat. No. 4,458,066. Chemical synthesis produces a single stranded oligonucleotide. This can be converted into double stranded DNA by hybridization with a complementary sequence, or by polymerization with a DNA polymerase using the single strand as a template. One of skill would recognize that while chemical synthesis of DNA is generally limited to sequences of about 100 bases, longer sequences may be obtained by the ligation of shorter sequences.

In one example, an Cas13d protein (such as a protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) is prepared by inserting the cDNA which encodes the Cas13d protein into a plasmid or vector. The insertion can be made so that the Cas13d protein is read in frame so that the Cas13d protein is produced.

The Cas13d nucleic acid coding sequence (such as one having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) can be inserted into an expression vector including, but not limited to a plasmid, virus or other vehicle that can be manipulated to allow insertion or incorporation of sequences and can be expressed in either prokaryotes or eukaryotes. Hosts can include microbial, yeast, insect, plant and mammalian organisms. The vector can encode a selectable marker, such as a thymidine kinase gene or antibiotic resistance gene.

Nucleic acid sequences encoding an Cas13d protein (such as one encoding a protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) can be operatively linked to expression control sequences. An expression control sequence operatively linked to an Cas13d coding sequence is ligated such that expression of the Cas13d protein coding sequence is achieved under conditions compatible with the expression control sequences. The expression control sequences include, but are not limited to appropriate promoters, enhancers, transcription terminators, a start codon (i.e., ATG) in front of an Cas13d protein-encoding gene, splicing signal for introns, maintenance of the correct reading frame of that gene to permit proper translation of mRNA, and stop codons.

In one embodiment, vectors are used for expression in yeast such as *S. cerevisiae, P. pastoris*, or *Kluyveromyces lactis*. Exemplary promoters for use in yeast expression systems include but are not limited to: the constitutive promoters plasma membrane H$^+$-ATPase (PMA1), glyceraldehyde-3-phosphate dehydrogenase (GPD), phosphoglycerate kinase-1 (PGK1), alcohol dehydrogenase-1 (ADH1), and pleiotropic drug-resistant pump (PDR5). In addition, many inducible promoters are of use, such as GAL1-IO (induced by galactose), PHO5 (induced by low extracellular inorganic phosphate), and tandem heat shock HSE elements (induced by temperature elevation to 37° C.). Promoters that direct variable expression in response to a titratable inducer include the methionine-responsive MET3 and MET25 promoters and copper-dependent CUP1 promoters. Any of these promoters may be cloned into multicopy (2μ) or single copy (CEN) plasmids to give an additional level of control in expression level. The plasmids can include nutritional markers (such as URA3, ADE3, HIS1, and others) for selection in yeast and antibiotic resistance (AMP) for propagation in bacteria. Plasmids for expression on *K. lactis* are known, such as pKLAC1.

Viral vectors can also be prepared that encode an Cas13d (such as one encoding a protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253). Exemplary viral vectors include polyoma, SV40, adenovirus, vaccinia virus, adeno-associated virus, herpes viruses including HSV and EBV, lentivirus, Sindbis viruses, alphaviruses and retroviruses of avian, murine, and human origin. Baculovirus (*Autographa californica* multinuclear polyhedrosis virus; AcMNPV) vectors can be used and obtained from commercial sources. Other suitable vectors include retrovirus vectors, orthopox vectors, avipox vectors, fowlpox vectors, capripox vectors, suipox vectors, adenoviral vectors, herpes virus vectors, alpha virus vectors, baculovirus vectors, Sindbis virus vectors, vaccinia virus vectors and poliovirus vectors. Specific exemplary vectors are poxvirus vectors such as vaccinia virus, fowlpox virus and a highly attenuated vaccinia virus (MVA), adenovirus, baculovirus and the like. Pox viruses of use include orthopox, suipox, avipox, and capripox virus. Orthopox include vaccinia, ectromelia, and raccoon pox. One example of an orthopox of use is vaccinia. Avipox includes fowlpox, canary pox and pigeon pox. Capripox include goatpox and sheeppox. In one example, the suipox is swinepox. Other viral vectors that can be used include other DNA viruses such as herpes simplex virus and adenoviruses, and RNA viruses such as retroviruses and polio.

Viral vectors that encode an Cas13d protein (such as one encoding a protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) can include at least one expression control element operationally linked to the nucleic acid sequence encoding the Cas13d protein. The expression control elements control and regulate the expression of the Cas13d nucleic acid sequence. Exemplary expression control elements that can be used include, but are not limited to, lac system, operator and promoter regions of phage lambda, yeast promoters and promoters derived from polyoma, adenovirus, retrovirus or SV40. In one example the promoter is CMV, U6, CBh, CMW, Cbh, EF1a. In one example, the promoter is a cell type specific promoter, such as synapsin or GFAP, or an inducible promoter, such as a tetracycline inducible promoter. Additional operational elements include, but are not limited to, leader sequence, termination codons, polyadenylation signals and any other sequences necessary for the appropriate transcription and subsequent translation of the nucleic acid sequence encoding the Cas13d protein in the host system. The expression vector can contain additional elements necessary for the transfer and subsequent replication of the expression vector containing the nucleic acid sequence in the host system. Examples of such elements include, but are not limited to, origins of replication and selectable markers.

In one example, the vector includes a polyA signal after the Cas13d protein coding sequence, a WPRE signal for expression in viral vectors, or combinations thereof.

In one example, the method uses direct delivery of an mRNA that encodes for an Cas13d protein.

C. Guide Nucleic Acid Molecules

The disclosure provides guide nucleic acid molecules, such as guide RNA (gRNA or crRNA, CRISPR (guide) RNA), which can be used in the methods, compositions, and kits provided herein. Such molecules can include naturally occurring or non-naturally occurring nucleotides or ribonucleotides (such as LNAs or other chemically modified nucleotides or ribonucleotides, for example to protect a guide RNA from degradation). In some examples, the guide sequence is RNA. The guide nucleic acid can include modified bases or chemical modifications (e.g., see Latorre et al., Angewandte Chemie 55:3548-50, 2016). A guide sequence directs an Cas13d protein to a target RNA, thereby targeting the RNA (e.g., modifying or detecting the RNA).

Guide molecules include one or more regions referred to as spacers. A spacer has sufficient complementarity with a target RNA sequence to hybridize with the target RNA and direct sequence-specific binding of an Cas13d protein to the target RNA. Thus, the spacer is the variable portion of the guide sequence. In some examples, a spacer has 100% complementarity to a target RNA (or region of the RNA to be target), but a spacer can have less than 100% complementarity to a target RNA, such as at least 80%, at least 85%, at least 90%, at least 95%, at least 98% or at least 99% complementarity to a target RNA.

A guide sequence can also include one or more direct repeats (DRs). The DR is the constant portion of the guide, which contains strong secondary structure (FIG. S2C), which facilitate interaction between an Cas13d protein and the guide molecule. Each ortholog has a slightly different DR sequence (e.g., SEQ ID NOS: 129, 130, 131, 132, 133, 134, 135, 136, 137, 148, 150, 151, 152, 154, 156, 157, 159, 161, 163, 165, 167, and 169). In one example, the gRNA includes at least one DR sequence having at least 80%, at least 85%, at least 90%, at least 92%, at least 95%, at least 96%, at least 97%, at least 98%, at least 99%, or 100% sequence identity to SEQ ID NO: 129, 130, 131, 132, 133, 134, 135, 136, 137, 148, 150, 151, 152, 154, 156, 157, 159, 161, 163, 165, 167, 169, 176, 178, 180, 182, 184, 186, 188, 190, 191, 192, 193, 199, 201, 203, 205, 207, 209, 211, 213, 215, 217, 219, 221, 223, 225, 227, 228, 230, 232, 234, 236, 238, 240, 242, 244, 246, 248, 250, 252, or 254 (such as 1, 2, 3, or 4 of such DR sequences).

In one example, a guide sequence includes a constant DR on its 5'-end and a variable spacer on its 3' end. In one example includes the sequence DR-spacer-DR-spacer. In some examples, the sequence DR-spacer is repeated two or more times, such as at least 3 times or at least 4 times. This type of sequence is called a guide array.

Guide molecules generally exist in various states of processing. In one example, an unprocessed guide RNA is 36 nt of DR followed by 30-32 nt of spacer. The guide RNA is processed (truncated/modified) by Cas13d itself or other RNases into the shorter "mature" form. In some embodiments, an unprocessed guide sequence is about, or at least about 30, 35, 40, 45, 50, 55, 60, 61, 62, 63, 64, 65, 66, 67, 68, 69, 70, 71, 72, 73, 74, 75, or more nucleotides (nt) in length. In some embodiments, a processed guide sequence is about 44 to 60 nt (such as 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, or 70 nt). In some embodiments, an unprocessed spacer is about 28-32 nt long (such as 25, 26, 27, 28, 29, 30, 31, 32, 33, 34, or 35 nt) while the mature (processed) spacer can be about 10 to 30 nt, 10 to 25 nt, 14 to 25 nt, 20 to 22 nt, or 14-30 nt (such as 10, 11, 12, 13, 14, 15, 16, 17, 18, 19, 20, 21, 22, 23, 24, 25, 26, 27, 28, 29, 30, 31, 32, 33, 34, or 35 nt). In some embodiments, an unprocessed DR is about 36 nt (such as 30, 31, 32, 33, 34, 35, 36, 37, 38, 39, 40 or 41 nt), while the processed DR is about 30 nt (such as 25, 26, 27, 28, 29, 30, 31, 32, 33, 34, or 35 nt).

The ability of a guide sequence to direct sequence-specific binding of a CRISPR complex to a target RNA may be assessed by any suitable assay. For example, the components of a CRISPR system sufficient to form a CRISPR complex, including the guide sequence to be tested, may be provided to a host cell having the corresponding target RNA molecule, such as by transfection with vectors encoding the components of the CRISPR sequence, followed by an assessment of preferential cleavage within the target sequence. Similarly, cleavage of a target RNA sequence may be evaluated in a test tube by providing the target RNA, components of a CRISPR complex, including the guide sequence to be tested and a control guide sequence different from the test guide sequence, and comparing binding or rate of cleavage at the target RNA between the test and control guide sequence reactions. Other assays are possible, and will occur to those skilled in the art.

Also provided are vectors, such as a viral vector or plasmid (e.g., retrovirus, lentivirus, adenovirus, adeno-associated virus, or herpes simplex virus), that includes a guide nucleic acid molecule. Exemplary vectors are described herein. In some examples, the guide nucleic acid molecule is operably linked to a promoter or expression control element (examples of which are provided elsewhere in this application). As described elsewhere herein, such vectors can include other elements, such as a gene encoding a selectable marker, such as an antibiotic, such as puromycin, hygromycin, or a detectable marker such as GFP or other fluorophore.

In one example, a plurality of gRNAs are part of an array (which can be part of a vector, such as a viral vector or plasmid). For example, a guide array including the sequence DR-spacer-DR-spacer-DR-spacer, can include three unique unprocessed gRNAs (one for each DR-spacer sequence). Once introduced into a cell or cell-free system, the array is processed by the Cas13d protein into the three individual mature gRNAs. This allows for multiplexing, e.g. the delivery of multiple gRNAs to a cell or system to target multiple target RNAs or multiple positions within a single target RNA (or combinations thereof).

D. Vectors that Encode Cas13d and Guide Nucleic Acid Molecules

The disclosure provides vectors, such as plasmids and viral vectors as described elsewhere herein, which include one or more guide molecule coding sequences (e.g., to permit targeting of one or more RNA molecules), and one or more Cas13d protein coding sequences. Such vectors can be used in the methods, compositions, and kits provided herein. Such vectors can include naturally occurring or non-naturally occurring nucleotides or ribonucleotides. Such vectors can include a single promoter operably linked to the guide molecule (which can be part of an array that includes at least two different guide molecules) and the Cas13d protein coding sequence. Alternatively, the guide molecule (which can be part of an array that includes at least two different guide molecules) and the Cas13d protein coding sequence can be operably linked to different promoters.

E. Recombinant Cells and Cell-Free Systems

Cells that include a non-native Cas13d protein, a non-native Cas13d protein coding sequence, a guide molecule (or coding sequence), or combinations thereof, are provided. Such recombinant cells can be used in the methods, compositions, and kits provided herein. Nucleic acid molecules encoding an Cas13d protein disclosed herein and/or nucleic acid molecules encoding a guide molecule can be introduced into cells to generate transformed (e.g., recombinant) cells. In some examples, such cells are generated by introducing one or more non-native Cas13d proteins and one or more guide molecules (e.g., gRNAs) into the cell, for example as a ribonucleoprotein (RNP) complex.

Similarly, cell free systems, such as those generated from lysed cells (or those that include an Cas13d RNP in a test tube or other vessel, into which in vitro transcribed or chemically synthesized target RNAs are added), which include a, Cas13d protein, a Cas13d protein coding sequence, a guide molecule (or coding sequence), or combinations thereof, are provided. Such cell free systems can be used in the methods, compositions, and kits provided herein. In some examples, one or more non-native Cas13d proteins and one or more guide molecules (e.g., gRNAs) are added to a cell free system, for example as a RNP complex.

Thus, cells and cell-free systems containing an Cas13d protein (such as a protein having at least 80%, at least 85%, at least 90%, at least 92%, at least 95%, at least 96%, at least 97%, at least 98%, at least 99%, or 100% sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 138, 147, 149, 153, 155, 158, 160, 162, 164, 166, 168, 170, 175, 177, 179, 181, 183, 185, 187, 189, 194, 198, 200, 202, 204, 206, 208, 210, 212, 214, 216, 218, 220, 222, 224, 226, 229, 231, 233, 235, 237, 239, 241, 243, 245, 247, 249, 251, or 253) are disclosed. Similarly, cells and cell-free systems containing a guide molecule, such as one having at least one DR sequence having at least 80%, at least 85%, at least 90%, at least 92%, at least 95%, at least 96%, at least 97%, at least 98%, at least 99%, or 100% sequence identity to SEQ ID NO: 129, 130, 131, 132, 133, 134, 135, 136, or 137, and in some examples also at least one spacer sequence complementary to a target RNA, are provided.

Such recombinant cells (e.g., which can be used to generate a cell-free system) can be eukaryotic or prokaryotic. Examples of such cells include, but are not limited to bacteria, archaea, plant, fungal, yeast, insect, and mammalian cells, such as *Lactobacillus, Lactococcus, Bacillus* (such as *B. subtilis*), *Escherichia* (such as *E. coli*), *Clostridium, Saccharomyces* or *Pichia* (such as *S. cerevisiae* or *P. pastoris*), *Kluyveromyces lactis, Salmonella typhimurium, Drosophila* cells, *C. elegans* cells, *Xenopus* cells, SF9 cells, C129 cells, 293 cells, *Neurospora*, and immortalized mammalian cell lines (e.g., Hela cells, myeloid cell lines, and lymphoid cell lines).

In one example, the cell is a prokaryotic cell, such as a bacterial cell, such as *E. coli*.

In one example, the cell is a eukaryotic cell, such as a mammalian cell, such as a human cell. In one example, the cell is primary eukaryotic cell, a stem cell, a tumor/cancer cell, a circulating tumor cell (CTC), a blood cell (e.g., T cell, B cell, NK cell, Tregs, etc.), hematopoietic stem cell, specialized immune cell (e.g., tumor-infiltrating lymphocyte or tumor-suppressed lymphocytes), a stromal cell in the tumor microenvironment (e.g., cancer-associated fibroblasts, etc.) In one example, the cell is a brain cell (e.g., neurons, astrocytes, microglia, retinal ganglion cells, rods/cones, etc.) of the central or peripheral nervous system).

In one example, a cell is part of (or obtained from) a biological sample, such as a biological specimen containing genomic DNA, RNA (e.g., mRNA), protein, or combinations thereof, obtained from a subject. Examples include, but are not limited to, peripheral blood, serum, plasma, urine, saliva, sputum, tissue biopsy, fine needle aspirate, surgical specimen, and autopsy material. Such cells can also be used to generate a cell free system.

In one example the cell (or cell free system) is from a tumor, such as a hematological tumor (e.g., leukemias, including acute leukemias (such as acute lymphocytic leukemia, acute myelocytic leukemia, acute myelogenous leukemia and myeloblastic, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (including low-, intermediate-, and high-grade), multiple myeloma, Waldenström's macroglobulinemia, heavy chain disease, myelodysplastic syndrome, mantle cell lymphoma and myelodysplasia) or solid tumor (e.g., sarcomas and carcinomas: fibrosarcoma, myxosarcoma, liposarcoma, chondrosarcoma, osteogenic sarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, bladder carcinoma, and CNS tumors (such as a glioma, astrocytoma, medulloblastoma, craniopharyogioma, ependymoma, pinealoma, hemangioblastoma, acoustic neuroma, oligodendroglioma, menangioma, melanoma, neuroblastoma and retinoblastoma).

In one example the cell (or cell free system) is obtained from an environmental sample, such as a water, soil, or air sample.

F. Compositions & Kits

Compositions and kits that include a Cas13d protein, a Cas13d protein coding sequence, a guide molecule (or coding sequence), or combinations thereof, are provided. In one example, the composition or kit includes an RNP complex composed of one or more Cas13d proteins and one or more guide molecules (e.g., gRNAs). In one example, the composition or kit includes a vector encoding an Cas13d protein, a guide molecule, or both. In one example, the composition or kit includes a cell, such as a bacterial cell or eukaryotic cell, that includes a non-native Cas13d protein, a non-native Cas13d protein coding sequence, a guide molecule (or coding sequence), or combinations thereof. In one example, the composition or kit includes a cell-free system that includes a non-native Cas13d protein, a non-native Cas13d protein coding sequence, a guide molecule (or coding sequence), or combinations thereof.

Such compositions can include a pharmaceutically acceptable carrier (e.g., saline, water, PBS). In some examples, the composition is a liquid, lyophilized powder, or cryopreserved.

In some examples, the kit includes a delivery system (e.g., liposome, a particle, an exosome, a microvesicle, a viral vector, or a plasmid), and/or a label (e.g., a peptide or antibody that can be conjugated either directly to an Cas13d RNP or to a particle containing the Cas1 RNP to direct cell type specific uptake/enhance endosomal escape/enable blood-brain barrier crossing etc.). In some examples, the kits further include cell culture or growth media, such as media appropriate for growing bacterial, plant, insect, or mammalian cells.

In some examples, such parts of a kit are in separate containers.

G. Targeting RNA

The disclosed Cas13d proteins (and coding sequences), and guide molecules (e.g., gRNA and coding sequences) can be used in a CRISPR/Cas system to target one or more RNA molecules, such as those present in a sample (such as a biological sample, environmental sample (e.g., soil, air or water sample), and the like. In one example, the target RNA is a coding RNA. In one example, the target RNA is a nuclear RNA. In other examples, the target RNA is non-coding RNA (such as functional RNA, siRNA, microRNA, snRNA, snoRNA, piRNA, scaRNA, tRNA, rRNA, lncRNA, or lincRNA). Such RNA targeting methods can be performed in vitro (such as in cell culture or in a cell-free system), or in vivo (such as in an organism, embryo, or mammal).

The CRISPR/Cas system provided herein includes two general components: (1) an Cas13d protein or its coding sequence (whose expression can be driven by a promoter) and (2) a guide nucleic acid molecule, such as RNA (gRNA), which is specific for the target RNA (whose expression can also be driven by promoter. When introduced into cells (or to a cell free system) for example (1) as Cas13d mRNA and Cas13d gRNA, (2) as part of a single vector or plasmid or divided into multiple vectors or plasmids, (3) as separate Cas13d protein and guide molecules, or (4) as an RNP complex of the Cas13d protein and guide molecule, the guide molecule guides the Cas13d to the target RNA. If the Cas13d protein has a native HEPN domain(s) or is fused to an appropriate effector domain bearing RNase activity, the RNA can be cut. If the Cas13d protein has a mutated HEPN domain(s), a guide array can be processed into mature gRNAs, but the target RNA is not cut. Using this system, RNA sequences are easily targeted, for example edited or detected, optionally with an effector domain.

1. Introduction of Cas13d Protein Directly into a Cell

In one example, the Cas13d protein is expressed in a recombinant cell, such as *E. coli*, and purified. The resulting purified Cas13d protein, along with an appropriate guide molecule specific for the target RNA, is then introduced into a cell or organism where one or more RNAs can be targeted. In some examples, the Cas13d protein and guide nucleic acid molecule are introduced as separate components into the target cell/organism. In other examples, the purified Cas13d protein is complexed with the guide nucleic acid (e.g., gRNA), and this ribonucleoprotein (RNP) complex is introduced into target cells (e.g., using transfection or injection). In some examples, the Cas13d protein and guide molecule are injected into an embryo (such as a human, mouse, zebrafish, or *Xenopus* embryo).

Once the Cas13d protein and guide nucleic acid molecule are in the cell, one or more RNAs can be targeted.

2. Expression of Cas13d from Nucleic Acids

In one example, the Cas13d protein is expressed from a nucleic acid molecule in a cell containing a target RNA, for example an RNA to be detected or modified. In some such examples, the Cas13d protein is expressed from a vector, such as a viral vector or plasmid introduced into a cell or into a cell-free system. This results in the production of the Cas13d protein in the cell, organism, or system. In addition, these nucleic acid molecules can be co-expressed in the cell/organism/system with the guide nucleic acid molecule (e.g., gRNA) specific for the target RNA.

In one example, multiple plasmids or vectors are used for RNA targeting. The nucleic acid molecule encoding the Cas13d can be provided for example on one vector or plasmid, and the guide nucleic acid molecule (e.g., gRNA) on another plasmid or vector. Multiple plasmids or viral vectors can be mixed and introduced into cells (or a cell free system) at the same time, or separately.

In some examples, multiple nucleic acid molecules are expressed from a single vector or plasmid. For example, a single vector can include the nucleic acid molecule encoding the Cas13d, and a separate vector can include the guide molecule.

In some examples a plurality of different guide molecules (e.g., gRNAs), one for each target (such as 1, 2, 3, 4, 5, or 10 different targets), are present on a single array and/or vector. In one example, the method includes delivering a plurality of gRNAs (such as at least 2, at least 3, at least 4, at least 5, at least 10, at least 20, or at least 50 different gRNAs), which are part of an array (which can be part of a vector, such as a viral vector or plasmid). Once introduced into a cell or cell-free system, the array is processed by the Cas13d protein into the individual mature gRNAs.

The nucleic acid molecules expressed from the vector can be under the control of a promoter and optionally contain selection markers (such as antibiotic resistance).

In some examples, the protein and guide molecules are expressed by an embryo (such as a zebrafish or *Xenopus* embryo). The Cas13d protein can be expressed from injected plasmid DNA, injected mRNA, or stably integrated copies into the animal genome. The gRNA can be directly injected or expressed from a vector or stably integrated copies into the animal genome.

3. Targets

One or more RNAs can be targeted by the disclosed methods, such as at least 1, at least 2, at least 3, at least 4 or at least 5 different RNAs in a cell, cell-free system, or organism, such as 1, 2, 3, 4, 5, 6, 7, 8, 9 or 10 different RNAs. In one example, the RNA is associated with a disease such as cystic fibrosis, Huntington's disease, Tay-Sachs, Fragile X syndrome, Fragile X-associated tremor/ataxia syndrome, Duchenne muscular dystrophy, myotonic dystrophy, spinal muscular atrophy, spinocerebellar ataxia, or familial ALS. In one example, the RNA is associated with cancer (e.g., a cancer of the lung, breast, colon, liver, pancreas, prostate, bone, brain, skin (e.g., melanoma), or kidney). Examples of target RNAs include, but are not limited to those associated with cancer (e.g., BCR-ABL, Ras, Raf, p53, BRCA1, BRCA2, CXCR4, beta-catenin, HER2, and CDK4).

In one example, the RNA is associated with viral infection, such as infection by a positive-strand RNA viruses, such as Picornaviruses (such as Aphthoviridae [for example foot-and-mouth-disease virus (FMDV)]), Cardioviridae; Enteroviridae (such as Coxsackie viruses, Echoviruses, Enteroviruses, and Polioviruses); Rhinoviridae (Rhinoviruses)); Hepataviridae (Hepatitis A viruses); Togaviruses (examples of which include rubella; alphaviruses (such as Western equine encephalitis virus, Eastern equine encephalitis virus, and Venezuelan equine encephalitis virus)); Flaviviruses (examples of which include Dengue virus, West Nile virus, and Japanese encephalitis virus); Calciviridae (which includes Norovirus and Sapovirus); or Coronaviruses (examples of which include SARS coronaviruses, such as the Urbani strain), or a negative-strand RNA virus, such as Orthomyxoviruses (such as the influenza virus), Rhabdoviruses (such as Rabies virus), and Paramyxoviruses (examples of which include measles virus, respiratory syncytial virus, or parainfluenza viruses), or a DNA viral infection (such as infection by Herpesviruses (such as Varicella-zoster virus, for example the Oka strain; cytomegalovirus; and Herpes simplex virus (HSV) types 1 and 2), Adenoviruses (such as Adenovirus type 1 and Adenovirus type 41), Poxviruses (such as Vaccinia virus), or Parvoviruses (such as Parvovirus B19).

In one example, the RNA is associated with a bacterial infection or property of a bacterial infection, such as bacterial resistance, persistence, or antibiotic resistance. Detection of these RNAs can be used for diagnostic methods, while editing these RNAs in cell-based or cell-free systems can be used for therapeutic methods.

4. Methods of Detecting RNA

In one example, the method of targeting an RNA results in detecting, visualizing, or labeling a target RNA. For example, by using at least one Cas13d protein with a mutated HEPN domain (e.g., SEQ ID NO: 2 or 4), at least one gRNA containing at least one spacer sequence specific for the target RNA, and an effector module, the target RNA will be recognized by Cas13d but will not be cut or nicked while the effector module becomes activated. In some examples, such a method is used to detect a target RNA. Such a method can be used in a cell or cell free system to determine if a target RNA is present, such as in a tumor cell. In some examples, the cell or cell free system is obtained from a tissue sample, blood sample or saliva sample.

In one example, the method of detecting RNA comprises of an Cas13d protein fused to a fluorescent protein or other detectable label along with a gRNA containing a spacer sequence specific for the target RNA. Binding of Cas13d to the target RNA can be visualized by microscopy or other methods of imaging. In another example, RNA aptamer sequences can be appended to or inserted within the gRNA molecule, such as MS2, PP7, Qβ, and other aptamers. The introduction of proteins that specifically bind to these aptamers, e.g. the MS2 phage coat protein, fused to a fluorescent protein or other detectable label can be used to detect the target RNA because the Cas13d-gRNA-target RNA complex will be labeled via the aptamer interaction.

In another example, the method of detecting RNA is a transcriptional sensor (e.g., as part of a synthetic circuit) for diagnostics or therapeutics. For example, the transcriptional sensor can be comprised of at least one Cas13d protein with a mutated HEPN domain (e.g., SEQ ID NO: 2 or 4), at least one gRNA containing at least one spacer sequence specific for the target RNA, and an effector module such as an optionally split fluorescent protein or probe; an optionally split luminescent protein or probe; an optionally split enzyme that catalyzes a detectable reaction such as ubiquitin or TEV protease; a FRET-compatible protein pair; one or more transcription factor(s) fused to Cas13d via cleavable linkers; a split intein that trans-splices a protein to restore its function such as a transcription factor; a kinase-substrate pair that activates upon phosphorylation; one, two, or more monomers that activate upon dimerization or multimerization; or one or more proteins that induce conformational and functional change upon interaction. In one example, the spatial proximity of two or more Cas13d proteins and gRNAs due to binding a particular transcript would activate the effector module, resulting in a detectable signal or detectable activity in the cell.

For example, the transcriptional sensor could allow a cancer-specific transcript, inflammation-specific transcript, disease-specific transcript, or cell state-specific transcript to be detected. A synthetic circuit containing a Cas13d-based system that is able to sense particular transcripts could encode conditional logic, e.g. requiring target detection to up- or down-regulate a gene for therapeutic application.

In one example, the method results in a detectable agent being bound to the target RNA, which can be detected. For example, two separate Cas13d fusion proteins that each include part of a fluorophore (e.g., GFP), and two different gRNAs with different spacer sequences that target regions of an RNA in close proximity, can be used. When the two parts bind to the target RNA in proximity, the two parts of the fluorophore form a complete fluorophore, thereby generating a detectable signal.

In one example, the method results in RNA detection, for example by triggering a response such as expression of a second gene, modification of a protein, translocation of a protein or RNA to a different location, induction of cell death via suicide gene, induction of cell proliferation, induction of a transgene that enables a secondary function, induction of a permanent change in DNA sequence to enable storing a memory of past transcriptional events, or altering the RNA to enable pulldown.

In one embodiment, two halves of a transcription factor could be linked to two separate Cas13d via a split intein system. The Cas13d proteins are provided with two different gRNAs with different spacer sequences that target regions of an RNA in close proximity. Upon binding to the target RNA in proximity, the split inteins trans-splice a reconstituted transcription factor (TF) so that it can translocate to the nucleus and turn on a target gene or cluster of target genes. In one example, the target gene could be an endogenous gene in the cell. In another example, the target gene could be a transgene expressed on a vector or introduced through genetic engineering, such as a fluorescent protein or toxin.

5. Methods of Detecting RNA in Cell-Free Systems

In one example, the method of detecting a target RNA in a cell-free system results in a detectable label or enzyme activity. For example, by using at least one Cas13d protein (e.g., SEQ ID NO: 3, 42, 62, 70, 82, 83, and 92), at least one gRNA containing at least one spacer sequence specific for the target RNA, and a detectable label, the target RNA will be recognized by Cas13d. The binding of the target RNA by Cas13d triggers its RNase activity, which can lead to the cleavage of the target RNA as well as the detectable label.

In one example, the detectable label is an RNA linked to a fluorescent probe and quencher. The intact detectable RNA links the fluorescent probe and quencher, suppressing fluorescence. Upon cleavage by Cas13d of the detectable RNA, the fluorescent probe is released from the quencher and displays fluorescent activity. Such a method can be used to determine if a target RNA is present in a lysed cell sample, lysed tissue sample, blood sample, saliva sample, environmental sample (such as a water, soil, or air sample), or other lysed cell or cell-free sample. Such a method can also be used to detect a pathogen, such as a virus or bacteria, or diagnose a disease state, such as a cancer.

In one example, the detection of the target RNA aids in the diagnosis of disease and/or pathological state, or the existence of a viral or bacterial infection. For example, Cas13d-mediated detection of non-coding RNAs such as PCA3 can be used to diagnose prostate cancer if detected in patient urine. In another example, Cas13d-mediated detection of the lncRNA-AA174084, which is a biomarker of gastric cancer, can be used to diagnose gastric cancer.

6. Methods of Editing Target RNA

In one example, the method of targeting an RNA results in editing the sequence of a target RNA. For example, by using an Cas13d protein with a non-mutated HEPN domain (e.g., SEQ ID NOS: 1, 3, 42, 62, 70, 82, 83, and 92), and a gRNA containing at least one a spacer sequence specific for the target RNA, the target RNA can be cut or nicked at a precise location. In some examples, such a method is used to decrease expression of a target RNA, which will decrease translation of the corresponding protein. Such a method can be used in a cell where increased expression of an RNA is not desired. In one example, the RNA is associated with a disease such as cystic fibrosis, Huntington's disease, Tay-Sachs, Fragile X syndrome, Fragile X-associated tremor/ataxia syndrome, muscular dystrophy, myotonic dystrophy, spinal muscular atrophy, spinocerebellar ataxia, or familial ALS. In another example, the RNA is associated with cancer (e.g., a cancer of the lung, breast, colon, liver, pancreas, prostate, bone, brain, skin (e.g., melanoma), or kidney). Examples of target RNAs include, but are not limited to those associated with cancer (e.g., PD-L1, BCR-ABL, Ras, Raf, p53, BRCA1, BRCA2, CXCR4, beta-catenin, HER2, and CDK4). Editing such target RNAs can have a therapeutic effect.

In another example, the RNA is expressed in an immune cell. The target RNA could, for example, code for a protein leading to the repression of a desirable immune response, such as infiltration of a tumor. Knock-down of such an RNA could enable progression of such a desirable immune response (e.g., PD1, CTLA4, LAG3, TIM3). In another example, the target RNA encodes a protein resulting in the undesirable activation of an immune response, for example in the context of an autoimmune disease such as multiple sclerosis, Crohn's disease, lupus, or rheumatoid arthritis.

In one example, targeting the target RNA allows for decreasing expression of the target protein encoded by the RNA. For example, by using an Cas13d fusion protein with a mutated HEPN domain (e.g., SEQ ID NO: 2 or 4) and a translational repression domain (such as Pumilio or FBF PUF proteins, deadenylases, CAF1, Argonaute proteins, and others), and a guide RNA containing at least one spacer sequence specific for the target RNA, expression of a target RNA can be decreased.

In some examples, Cas13d can be fused to a ribonuclease (such as a PIN endonuclease domain, an NYN domain, an SMR domain from SOT1, or an RNase domain from Staphylococcal nuclease) or a domain that affects RNA stability (such as tristetraprolin or domains from UPF1, EXOSC5, and STAU1).

In another example, RNA aptamer sequences can be appended to or inserted within the gRNA molecule, such as MS2, PP7, Qβ, and other aptamers. Proteins that specifically bind to these aptamers, e.g. the MS2 phage coat protein, can be fused to a translational repression domain, a ribonuclease, or a domain that affects RNA stability. This aptamer-effector domain fusion can be used to target the target RNA because the Cas13d and gRNA complex will guide the aptamer protein-effector domain in proximity to the target RNA.

Such a method can be used in a cell where increased expression of an RNA is not desired, such as when an expressed RNA is associated with a disease such as cystic fibrosis, Huntington's disease, Tay-Sachs, Fragile X syndrome, Fragile X-associated tremor/ataxia syndrome, muscular dystrophy, myotonic dystrophy, spinal muscular atrophy, spinocerebellar ataxia, or familial ALS. In another example, the target RNA is associated with cancer (e.g., a cancer of the lung, breast, colon, liver, pancreas, prostate, bone, brain, skin (e.g., melanoma), or kidney). Examples of target RNAs include, but are not limited to those associated with cancer (e.g., PD-L1, BCR-ABL, Ras, Raf, p53, BRCA1, BRCA2, CXCR4, beta-catenin, HER2, and CDK4). Editing such target RNAs would have a therapeutic effect.

In another example, the RNA is expressed in an immune cell. The target RNA could, for example, code for a protein leading to the repression of a desirable immune response, such as infiltration of a tumor. Knock-down of such an RNA could enable progression of such a desirable immune response (e.g., PD1, CTLA4, LAG3, TIM3). In another example, the target RNA could encode a protein resulting in the undesirable activation of an immune response, for example in the context of an autoimmune disease such as multiple sclerosis, Crohn's disease, lupus, or rheumatoid arthritis.

In one example, targeting the target RNA allows for activating or increasing expression of the target RNA. For example, by using an Cas13d fusion protein with a mutated HEPN domain (e.g., SEQ ID NO: 2 or 4) and a translational activation domain (such as eIF4E and other translation initiation factors, a domain of the yeast poly(A)-binding protein or GLD2), and a guide RNA containing at least one a spacer sequence specific for the target RNA, expression of a target RNA can be increased. Aptamer introduction into the gRNA with a cognate aptamer-binding protein fused to a translational activation domain can also be used. In one example, RNA aptamer sequences are appended to or inserted within the gRNA molecule, such as MS2, PP7, Qβ, and other aptamers. The introduction of proteins that specifically bind to these aptamers, e.g. the MS2 phage coat protein, fused to a translational activation domain can be used to target the target RNA because the Cas13d and gRNA complex will bring the aptamer protein-translational activation domain in proximity to the target RNA.

In some examples, such a method is used to increase the activity or expression of a target RNA, which will increase translation of the corresponding protein (if the RNA is a coding RNA). Such a method can be used in a cell where increased expression of an RNA is desired, such as a heterozygous genetic disease or disorders caused by copy number variation. Increasing translation of a desired protein product could be therapeutic in nature.

In another example, increasing the expression of a target RNA (such as Cyclin B1) can render the target cell (such as cancers) more sensitive to drugs (such as chemotherapeutic agents).

In one example, targeting the target RNA allows for one or more RNA base substitutions, RNA base edits, RNA base deletions, RNA base insertions, or combinations thereof, in the target RNA. In some examples, the Cas13d protein with a mutated HEPN domain is associated, either via direct fusion or a gRNA-aptamer modification, an effector domain that allows base edits (such as a cytidine deaminase, PPR protein, adenosine deaminase, ADAR family protein, or APOBEC family protein). In some examples, such a method is used to modify an RNA sequence, edit an RNA mutation, or modify an RNA transcript (e.g., gene therapy), for example to treat diseases such as ALS and melanoma or genetic disorders caused by undesired splice sites, such as Leber congenital amaurosis.

In one example, targeting the target RNA allows for methylating the target RNA. Some examples may use a chimeric Cas13d protein with a mutated HEPN domain (e.g., SEQ ID NO: 2 or 4) associated either via direct fusion or a gRNA-aptamer modification with a methylation domain (e.g., m6A), and a guide RNA containing at least one a spacer sequence specific for the target RNA. In some examples, such a method is used to combat aberrant RNA demethylation. In one example, such a method is used modify the methylation levels of pluripotency transcripts such as NANOG or KLF4 for example to decrease their stability in breast cancer cells, which can suppress the acquisition of breast cancer stem cell phenotypes that are associated with increased proliferation and cancer stem cell formation.

In one example, targeting the target RNA allows for demethylating the target RNA. Some examples can use Cas13d protein with a mutated HEPN domain (e.g., SEQ ID NO: 2 or 4), a guide RNA containing at least one a spacer sequence specific for the target RNA, and a demethylation domain (e.g., human alkylation repair homolog 5 or Alkbh5). The demethylation domain can be associated either via direct fusion to the Cas13d protein or via a gRNA-aptamer modification. In some examples, such a method is used to reverse aberrant RNA methylation, for example to treat myeloid leukemia by decreasing $m^6A$ levels.

In one example, targeting the target RNA allows for binding to the target RNA. For example, by using a Cas13d protein with a mutated HEPN domain (e.g., SEQ ID NO: 2 or 4) and a guide RNA containing at least one a spacer sequence specific for the target RNA, molecules can be bound or tethered to a target RNA. In some examples, such a method is used to capture the target RNA (e.g., immunoprecipitation). This can be used as part of a kit to identify the proteins interacting with a specific RNA transcript. In one example, an epitope tagged Cas13d (e.g. FLAG, HA, biotin, HALO tag) can be targeted to specific target RNAs and cross-linked via fixation (e.g. with paraformaldehyde or glutaraldehyde). Immunoprecipitation of Cas13d with an epitope-recognizing antibody allows for the identification of co-immunoprecipitated proteins via Western blot or mass spectrometry.

In another example, Cas13d can be fused to a biotin ligase (such as BirA) or a peroxidase (such as APEX2) in order to biotinylate proteins that interact with the target RNA. Labeled proteins can then be pulled down with streptavidin beads followed by mass spectrometry or Western blot.

In some examples, biotinylated Cas13d could be targeted to ribosomal RNA sequences with a gRNA. Streptavidin bead-mediated pulldown can be used to deplete rRNA for RNA sequencing library preparation.

In one example, targeting the target RNA allows for masking the target RNA. For example, by using an Cas13d protein with a mutated or intact HEPN domain and a guide RNA containing at least one a spacer sequence specific for the target RNA, a target RNA can be masked from RNA-binding proteins or RNA-binding elements such as miRNAs.

In some examples, the Cas13d can be used to mask RNA binding sites from RNA-binding proteins (RBPs). In another example, Cas13d can mask miRNA binding sites. For example, the liver-specific miR-122 forms a complex with Hepatitis C viral RNA which protects it from degradation. A HEPN-active Cas13d protein could be targeted to the miRNA-122 binding site on the viral RNA to synergistically combat HCV infections by simultaneously reversing miRNA-122-mediated protection and directly degrading HCV RNA. In some examples, such a method is used to preserve or protect the target RNA molecule, for example to protect the target RNA from degradation. For example, by targeting AU-rich elements in the 3' UTR of a target gene, a HEPN-mutated Cas13d can block binding of RNA-binding proteins such as tristetraprolin (TTR) or AUF1, which lead to degradation of the target transcript.

In one example, targeting the target RNA allows for changing splicing of the target RNA. Both the direct binding of splice acceptor and/or donor sites as well as splice effector domains can be used to manipulate splicing. For example, by using an Cas13d protein with a mutated HEPN domain (e.g., SEQ ID NO: 2 or 4), a guide RNA containing at least one a spacer sequence specific for the target RNA, and optionally an effector domain that affects splicing (such as the RS-rich domain of SRSF1, the Gly-rich domain of hnRNP A1, the alanine-rich motif of RBM4, or the proline-rich motif of DAZAP1), alternative splicing of the RNA can be achieved.

In some examples, such a method is used for exon inclusion, for example to include exon 2 of acid alpha-glucosidase (GAA) to treat Pompe disease or to include exon 7 of SMN2 to treat spinal muscular atrophy (SMA). In some examples, such a method is used for exon exclusion, for example to restore the reading frame of dystrophin to treat Duchenne muscular dystrophy or to shift the splicing of the Bcl-x pre-mRNA from the antiapoptotic long isoform to the proapoptotic short isoform to treat cancer.

In some examples, the method uses the Cas13d protein with a mutated HEPN domain to mask splice acceptor or donor sites, for example to create neoantigens to make cold tumors hot. By affecting the splicing of certain target pre-mRNAs, this method can generate novel exon-exon junctions that can lead to the creation of neo-epitopes in cancer cells. This can make a cancer cell vulnerable to the immune system due to the display of unnatural antigens. In other examples, this method can be used to dynamically manipulate isoform ratios or to restore reading frame of a protein (e.g., dystrophin for Duchenne's muscular dystrophy).

In one example, targeting the target RNA allows for controlling transcript trafficking of the target RNA. For example, by using an Cas13d fusion protein with a mutated HEPN domain (e.g., SEQ ID NO: 2 or 4) and a subcellular localization signal or export sequence, a guide RNA containing at least one a spacer sequence specific for the target RNA. In some examples, such a method is used to traffic the target RNA molecule to a particular organelle or cytosolic compartment, or even export the target RNA transcript, for example to endosomes for extracellular release In another example, the method can affect RNA trafficking. For example, the zipcode binding protein ZBP1 specifically recognizes an RNA sequence 5'-CGGAC(C/A-CA-C/U) that leads to localization of certain transcripts to the leading edge of fibroblasts. By masking or manipulating particular RNA zipcodes or regulatory sequences from recognition by regulatory protein complexes, this method can affect RNA localization or trafficking within a cell.

In one example, the target RNA is a nuclearly localized RNA. For example, by using an Cas13d protein with a non-mutated HEPN domain (e.g., SEQ ID NOS: 1, 3, 42, 62, 70, 82, 83, and 92) fused to a nuclear localization signal and a guide RNA containing at least one a spacer sequence specific for the target nuclear RNA, the nuclearly localized RNA can be targeted and degraded. In some examples, such a method is used to degrade the target nuclear RNA molecule, for example to knock-down a non-coding nuclear RNA such as HOTAIR, which is associated with metastatic progression in breast cancer.

In one example, the target RNA is viral RNA or transcript of a DNA virus. For example, an Cas13d protein with a non-mutated HEPN domain (e.g., SEQ ID NOS: 1, 3, 42, 62, 70, 82, 83, and 92) and a guide RNA containing at least one spacer sequence specific for the target RNA can be used. In some examples, such a method is used to treat an RNA viral infection (such as infection by a positive-strand RNA viruses, such as Picornaviruses (such as Aphthoviridae [for example foot-and-mouth-disease virus (FMDV)]), Cardioviridae; Enteroviridae (such as Coxsackie viruses, Echoviruses, Enteroviruses, and Polioviruses); Rhinoviridae (Rhinoviruses)); Hepataviridae (Hepatitis A viruses); Togaviruses (examples of which include rubella; alphaviruses (such as Western equine encephalitis virus, Eastern equine encephalitis virus, and Venezuelan equine encephalitis virus)); Flaviviruses (examples of which include Dengue virus, West Nile virus, and Japanese encephalitis virus); Calciviridae (which includes Norovirus and Sapovirus); or Coronaviruses (examples of which include SARS coronaviruses, such as the Urbani strain), or a negative-strand RNA virus, such as Orthomyxyoviruses (such as the influenza virus), Rhabdoviruses (such as Rabies virus), and Paramyxoviruses (examples of which include measles virus, respiratory syncytial virus, or parainfluenza viruses), or a DNA viral infection (such as infection by Herpesviruses (such as Varicella-zoster virus, for example the Oka strain; cytomegalovirus; and Herpes simplex virus (HSV) types 1 and 2), Adenoviruses (such as Adenovirus type 1 and Adenovirus type 41), Poxviruses (such as Vaccinia virus), or Parvoviruses (such as Parvovirus B19), for example by cutting the viral RNA or transcript of a DNA virus. Thus, such methods can be used as an RNA-based antiviral or antimicrobial.

EXAMPLE 1

Materials and Methods

This example describes the materials and methods used to obtain the results shown in Examples 2-7.

Cell Culture of Human Embryonic Kidney (HEK) Cell Line 293FT

Human embryonic kidney (HEK) cell line 293FT (Thermo Fisher) was maintained in DMEM (4.5 g/L glucose), supplemented with 10% FBS (GE Life Sciences) and 10 mM HEPES at 37° C. with 5% $CO_2$. Upon reaching 80-90% confluency, cells were dissociated using TrypLE Express (Life Technologies) and passaged at a ratio of 1:2.

Cell Culture of Human Bone Osteosarcoma Epithelial Cell Line U2OS

Human bone osteosarcoma epithelial U20S were maintained in DMEM (4.5 g/L glucose) supplemented with 10% FBS and 10 mM HEPES at 37° C. with 5% $CO_2$. Cells were passaged at a 1:3 ratio upon reaching 70% confluence. This cell line was not authenticated.

Maintenance of Induced Pluripotent Stem Cells and Neuronal Differentiation

Stable human iPSC lines containing the FTDP-17 IVS10+ 16 mutation or age- and sex-matched control lines were obtained from the laboratory of Fen-Biao Gao (Biswas et al., 2016). Briefly, cells obtained from one male patient with the MAPT IVS10+16 mutation and two separate lines from one male control patient were reprogrammed into hiPSCs (Almeida et al., 2012). iPSCs were transduced with lentivirus containing a doxycycline-inducible Ngn2 cassette. Lentiviral plasmids were a gift from S. Schafer and F. Gage. iPSCs were then passaged with Accutase and plated into a Matrigel-coated 6-well plate with mTESR media containing ROCK inhibitor Y-27632 (10 µM, Cayman) at 500,000 cells per well. On day 1, media was changed with mTESR. On day 2, media was changed to mTESR containing doxycycline (2 µg/ml, Sigma) to induce Ngn2 expression. On day 3, culture media was replaced with Neural Induction media (NIM, DMEM/F12 (Life Technologies) containing BSA (0.1 mg/ml, Sigma), apo-transferrin (0.1 mg/ml, Sigma), putrescine (16 µg/ml, Sigma), progesterone (0.0625 µg/ml, Sigma), sodium selenite (0.0104 µg/ml, Sigma), insulin (5 µg/ml, Roche), BDNF (10 ng/ml, Peprotech), SB431542 (10 µM, Cayman), LDN-193189 (0.1 µM, Sigma), laminin (2 µg/ml, Life Technologies), doxycycline (2 µg/ml, Sigma) and puromycin (Life Technologies)). NIM media was changed daily. Following 3 days of puromycin selection, immature neuronal cells were passaged with Accumax (Innovative Cell Technologies) and plated onto 96-well plates coated with poly-D-lysine and Matrigel in Neural Maturation media (NMM; 1:1 Neurobasal/DMEM (Life Technologies) containing B27 (Life Technologies), BDNF (10 ng/ml, Peprotech), N-Acetyl cysteine (Sigma), laminin (2 µg/ml, Life Technologies), dbcAMP (49 µg/ml, Sigma) and doxycycline (2 µg/ml, Sigma). Media was replaced the next day (day 7) with NMM containing AraC (2 µg/ml, Sigma) to eliminate any remaining non-differentiated cells. On day 8, AraC was removed and astrocytes were plated on top of neurons to support neuron cultures in NMM containing hbEGF (5 ng/ml, Peprotech). Cells were transduced with AAV on day 10 and assayed on day 24.

Computational Pipeline for Cas13d Identification

We obtained whole genome, chromosome, and scaffold-level prokaryotic genome assemblies from NCBI Genome in June 2016 and compared CRISPRfinder, PILER-CR, and CRT for identifying CRISPR repeats. The 20 kilobase flanking regions around each putative CRISPR repeat was extracted to identify nearby proteins and predicted proteins using Python. Candidate Cas proteins were required to be >750 aa in length and within 5 proteins of the repeat array, and extracted CRISPR loci were filtered out if they contained Cas genes associated with known CRISPR systems such as types I-III CRISPR. Putative effectors were clustered into families via all-by-all BLASTp analysis followed by single-linkage hierarchical clustering where a bit score of at least 60 was required for cluster assignment. Each cluster of at least 2 proteins was subjected to BLAST search against the NCBI non-redundant (nr) protein database, requiring a bit score >200 to assign similarity. The co-occurrence of homologous proteins in each expanded cluster to a CRISPR array was analyzed and required to be >70%. Protein families were sorted by average amino acid length and multiple sequence alignment for each cluster was performed using Clustal Omega and the Geneious aligner with a Blosum62 cost matrix. The RxxxxH HEPN motif was identified in the Cas13d family on the basis of this alignment. TBLASTN was performed on all predicted Cas13d effectors against public metagenome whole genome shotgun sequences without predicted open reading frames (ORFs). The Cas13d family was regularly updated via monthly BLAST search on genome and metagenome databases to identify any newly deposited sequences. New full-length homologs and homologous fragments were aligned using Clustal Omega and clustered using PhyML 3.2. CRISPRDetect was used to predict the direction of direct repeats in the Cas13d array and DR fold predictions were performed using the Andronescu 2007 RNA energy model at 37° C. Sequence logos for Cas13d direct repeats were generated using Geneious 10.

Protein Expression and Purification

Recombinant Cas13d proteins were PCR amplified from genomic DNA extractions of cultured isolates or metagenomic samples and cloned into a pET-based vector with an N-terminal His-MBP fusion and TEV protease cleavage site. The resulting plasmids were transformed into Rosetta2 (DE3) cells (Novagen), induced with 200 µM IPTG at OD$_{600}$ 0.5, and grown for 20 hours at 18° C. Cells were then pelleted, freeze-thawed, and resuspended in Lysis Buffer (50 mM HEPES, 500 mM NaCl, 2 mM MgCl2, 20 mM Imidazole, 1% v/v Triton X-100, 1 mM DTT) supplemented with 1× protease inhibitor tablets, 1 mg/mL lysozyme, 2.5 U/mL Turbo DNase (Life Technologies), and 2.5 U/mL salt active nuclease (Sigma Aldrich). Lysed samples were then sonicated and clarified via centrifugation (18,000×g for 1 hour at 4° C.), filtered with 0.45 µM PVDF filter and incubated with 50 mL of Ni-NTA Superflow resin (Qiagen) per 10 L of original bacterial culture for 1 hour. The bead-lysate mixture was applied to a chromatography column, washed with 5 column volumes of Lysis Buffer, and 3 column volumes of Elution Buffer (50 mM HEPES, 500 mM NaCl, 300 mM Imidazole, 0.01% v/v Triton X-100, 10% glycerol, 1 mM DTT). The samples were then dialyzed overnight into TEV Cleavage Buffer (50 mM Tris-HCl, 250 mM KCl, 7.5% v/v glycerol, 0.2 mM TCEP, 0.8 mM DTT, TEV protease) before cation exchange (HiTrap SP, GE Life Sciences) and gel filtration (Superdex 200 16/600, GE Life Sciences). Purified, eluted protein fractions were pooled and frozen at 4 mg/mL in Protein Storage Buffer (50 mM Tris-HC, 1M NaCl, 10% glycerol, 2 mM DTT).

Preparation of Guide and Target RNAs

Oligonucleotides carrying the T7 promoter and appropriate downstream sequence were synthesized (IDT) and annealed with an antisense T7 oligo for crRNAs and PCR-amplified for target and array templates. Homopolymer target RNAs were synthesized by Synthego. The oligo anneal and PCR templates were in vitro transcribed with the Hiscribe T7 High Yield RNA Synthesis kit (New England Biolabs) at 31° C. for 12 hours. For labeled targets, fluorescently labelled aminoallyl-UTP atto 680 (Jena Biosciences) was additionally added at 2 mM. Guide RNAs were purified with RNA-grade Agencourt AMPure XP beads (Beckman Coulter) and arrays and targets were purified with MEGAclear Transcription Clean-Up Kit (Thermo Fisher) and frozen at –80° C. For ssDNA and dsDNA targets, corresponding oligonucleotide sequences were synthesized (IDT) and either gel purified, or PCR amplified and then subsequently gel purified respectively.

Biochemical Cleavage Reactions

Purified EsCas13d protein and guide RNA were mixed (unless otherwise indicated) at 2:1 molar ratio in RNA Cleavage Buffer (25 mM Tris pH 7.5, 15 mM Tris pH 7.0, 1 mM DTT, 6 mM MgCl2). The reaction was prepared on ice and incubated at 37° C. for 15 minutes prior to the addition of target at 1:2 molar ratio relative to EsCas13d. The reaction was subsequently incubated at 37° C. for 45 minutes and quenched with 1 µL of enzyme stop solution (10 mg/mL Proteinase K, 4M Urea, 80 mM EDTA, 20 mM Tris pH 8.0) at 37° C. for 15 minutes. The reaction was then denatured with 2×RNA loading buffer (2×: 13 mM Ficoll, 8M Urea, 25 mM EDTA), at 85° C. for 10 minutes, and separated on a 10% TBE-Urea gel (Life Technologies). Gels containing labeled targets were visualized on the Odyssey Imager (Li-Cor); unlabeled array or target cleavage gels were stained with SYBR Gold prior to imaging via Gel Doc EZ system (Bio-Rad).

Transient Transfection of Human Cell Lines

Engineered Cas13 coding sequences were cloned into a standardized plasmid expression backbone containing an EF1a promoter and prepared using the Nucleobond Xtra Midi EF Kit (Machery Nagel) according to the manufacturer's protocol. NLS-LwaCas13a-msfGFP and PspCas13b-NES-HIV were PCR amplified from Addgene #103854, and #103862, respectively, a gift from Feng Zhang. Cas13d pre-gRNAs and gRNAs were cloned into a minimal backbone containing a U6 promoter. shRNAs and guides for LwaCas13a were cloned into the same backbone and position matched to their corresponding guide RNA at the 3' of the target sequence. Matched gRNAs for PspCas13b were moved to the closest 5'-G nucleotide.

For transient transfection, HEK 293FT cells were plated at a density of 20,000 cells per well in a 96-well plate and transfected at >90% confluence with 200 ng of Cas13 expression plasmid and 200 ng of gRNA expression plasmid using Lipofectamine 2000 (Life Technologies) according to the manufacturer's protocol. Transfected cells were harvested 48-72 hours post-transfection for flow cytometry, gene expression analysis, or other downstream processing.

For reporter assays, HEK 293FT cells were transfected in 96-well format with 192 ng of Cas13d expression plasmid, 192 ng of guide expression plasmid, and 12 ng of mCherry expression plasmid with Lipofectamine 2000 (Life Technologies). Cells were harvested after 48 hours and analyzed by flow cytometry.

U2OS cells were plated at a density of 20,000 cells per well in a 96-well plate and transfected at >90% confluence with 100 ng of Cas13d expression plasmid using Lipofectamine 3000 (Life Technologies) according to the manufacturer's protocol and processed for immunocytochemistry after 48 h.

Flow Cytometry

Cells were dissociated 48 hours post-transfection with TrypLE Express and resuspended in FACS Buffer (1×DPBS$^{-/-}$, 0.2% BSA, 2 mM EDTA). Flow cytometry was performed in 96-well plate format using a MACSQuant VYB (Miltenyi Biotec) and analyzed using FlowJo 10. RG6 was a gift from Thomas Cooper (Addgene plasmid #80167) and modified to replace EGFP with mTagBFP2. All represented samples were assayed with three biological replicates. In the mCherry reporter assay, data is representative of at least 20,000 gated events per condition. In the splicing reporter assay, data is representative of at least 2,500 gated events per condition.

Gene Expression Analysis

Cells were lysed 48 hours post-transfection with DTT-supplemented RLT buffer and total RNA was extracted using RNeasy Mini Plus columns (Qiagen). 200 ng of total RNA was then reverse transcribed using random hexamer primers and Revertaid Reverse Transcriptase (Thermo Fisher) at 25° C. for 10 min, 37° C. for 60 min, and 95° C. for 5 min followed by qPCR using 2× Taqman Fast Advanced Master Mix (Life Technologies) and Taqman probes for GAPDH and the target gene as appropriate (Life Technologies and IDT). Taqman probe and primer sets were generally selected to amplify cDNA across the Cas13 or shRNA target site position to prevent detection of cleaved transcript fragments (see Table S4 of Konermann et al., Cell 173:1-12, 2018, herein incorporated by reference in its entirety). qPCR was carried out in 5 µL multiplexed reactions and 384-well format using the LightCycler 480 Instrument II (Roche). Fold-change was calculated relative to GFP-transfected vehicle controls using the ddCt method. One-way or two-way ANOVA with multiple comparison correction was used to assess statistical significance of transcript changes using Prism 7.

Immunohistochemistry

For immunohistochemical analysis, U2OS cells were cultured on 96-well optically clear plates (Greiner Bio-One), transfected as previously described, then fixed in 4% PFA (Electron Microscopy Sciences) diluted in PBS (Gibco) and washed with 0.3M glycine (Sigma) in PBS to quench PFA.

Samples were blocked and permeabilized in a PBS solution containing 8% donkey serum (Jackson ImmunoResearch), 8% goat serum (Cell Signaling Technologies), and 0.3% Triton-X 100 (Sigma) for one hour, followed by primary antibody incubation in 1% BSA (Fisher Bioreagents), 1% goat serum, and 0.25% Triton-X overnight at 4° C. Samples were washed 3 times with PBS containing 0.1% BSA and 0.1% Triton-X 100 before incubating with fluorophore-conjugated secondary antibodies in PBS with 0.05% Triton-X 100 and 1% BSA at room temperature for one hour. Cells were washed with PBS with 0.1% Triton-X, stained with DAPI, and then covered with Mounting Media (Ibidi) before imaging. Primary antibody, HA-Tag 6E2 (Cell Signaling, 2367), was used at a 1:100 dilution as per manufacturer's instructions. Secondary antibodies used were goat anti-mouse IgG1-Alexa-Fluor 647 (Thermo Fisher, A21240) and Anti-Mouse IgG1 CF 633 (Sigma, SAB4600335). Confocal images were taken using a Zeiss Airyscan LSM 880 followed by image processing in Zen 2.3 (Zeiss).

Bacterial Small RNA Sequencing and Analysis

E. coli DH5α cells were transformed with pACYC184 carrying the CRISPR-Cas13d locus derived from an uncultured *Ruminococcus* sp. strain. Cells were harvested in stationary phase, rinsed in PBS, resuspended in TRIzol (Life Technologies), transferred to Lysing Matrix B tubes containing 0.1 mm silica beads (MP Biomedicals), and homogenized on a Bead Mill 24 (Fisher Scientific) for three 30-second cycles. Total RNA was isolated by phenol-chloroform extraction, then purified using the DirectZol Miniprep Kit (Zymo Research). RNA quality was assessed on an Agilent 2200 Tapestation followed by Turbo DNase treatment (Ambion). Total RNA was treated with T4 Polynucleotide Kinase (NEB) and rRNA-depleted using the Ribo-Zero rRNA Removal Kit for bacteria (Illumina). RNA was treated with RNA 5' polyphosphatase, poly(A)-tailed with E. coli poly(A) polymerase, and ligated with 5' RNA sequencing adapters using T4 RNA ligase 1 (NEB). cDNA was generated via reverse transcription using an oligo-dT primer and M-MLV RT/RNase Block (AffinityScript, Agilent) followed by PCR amplification and barcoding. Resulting libraries were sequenced on Illumina MiSeq, demultiplexed using custom Python scripts, and aligned to the Cas13d CRISPR locus using Bowtie 2. Alignments were visualized with Geneious.

Ngn2 Lentivirus Preparation

Low passage HEK 293FT cells were transfected with Polyethylenimine Max (PEI, Polysciences) and Ngn2 target plasmid plus pMDG.2 and psPAX2 packaging plasmids (a gift from Didier Trono, Addgene #12259 and #12260) in DMEM+10% FBS media during plating. The following day, media was changed to serum-free chemically defined minimal medium (Ultraculture supplemented with Glutamax, Lonza). Viral supernatant was harvested 48 h later, clarified through a 0.45 micron PVDF filter (Millipore) and concentrated using ultracentrifugation.

AAV Preparation

Low passage HEK 293FT cells were transfected with Polyethylenimine Max (PEI, Polysciences) and AAV target plasmid plus AAV1 serotype and pAdDeltaF6 helper packaging plasmids (UPenn Vector Core) in DMEM+10% FBS media during plating. The following day, 60% of the media was changed to chemically defined minimal medium (Ultraculture supplemented with Glutamax, Lonza). 48 h later, AAV-containing supernatant was harvested and clarified through a 0.45 μm PVDF filter (Millipore) and concentrated using precipitation by polyethylene glycol (PEG virus precipitation kit #K904, Biovision) following the manufacturer's protocol.

RNA-seq Library Preparation and Sequencing 48 h after transfection, total RNA was extracted from 293FT cells using the RNeasy Plus Mini kit from Qiagen. Stranded mRNA libraries were prepared using the NEBNext II Ultra Directional RNA Library Prep Kit from New England Biolabs (Cat# E7760S) and sequenced on an Illumina NextSeq500 with 42 nt paired end reads. ~15M total reads were demultiplexed per condition.

RNA-seq Analysis

Sequenced reads were quality-tested using FASTQC and aligned to the hg19 human genome using the 2.5.1 b STAR aligner (Dobin et al., 2013). Mapping was carried out using default parameters (up to 10 mismatches per read, and up to 9 multi-rmapping locations per read). The genome index was constructed using the gene annotation supplied with the hg19 Illumina iGenomes collection (Illumina) and sjdbOverhang value of 100. Uniquely mapped reads were quantified across all gene exons using the top-expressed isoform as proxy for gene expression with the HOMER analysis suite (Heinz et al., 2010), and differential gene expression was carried out with DESeq2 v 1.14.1 (Love et al., 2014) using triplicates to compute within-group dispersion and contrasts to compare between targeting and non-targeting conditions. Significant differentially expressed genes were defined as having a false discovery rate (FDR) <0.01 and a log 2 fold change >0.75. Volcano plots were generated in R 3.3.2 using included plotting libraries and the alpha( ) color function from the scales 0.5.0 package.

Statistics

All values are reported as mean±SD or mean±SEM as indicated in the appropriate figure legends. For comparing two groups, a one-tailed student's t-test was used and statistical significance was determined using the Holm-Sidak method with alpha=0.05. A one-way ANOVA with Tukey multiple hypothesis correction was used to assess significance between more than two groups. Two-way ANOVA was used when comparing across two factors (i.e., RNA targeting modality and guide position) and adjusted for multiple hypothesis correction by Sidak's multiple comparisons test. For comparing groups that were found to not meet the assumption of a normal distribution by a D'Agostino and Pearson normality test, the non-parametric Friedman test with Dunn's multiple comparison adjustment was performed. PRISM 7.0 was used for all statistical analysis. Sample sizes were not determined a priori. At least three biological replicates were used for each experiment, as indicated specifically in each figure.

Sequencing data reported herein can be found in the NCBI Gene Expression Omnibus under GEO Series accession number GSE108519.

Additional details on the materials and methods used, such as sequences (e.g., Tables S1 to S5), can be found in Konermann et al., Cell 173:1-12, 2018, herein incorporated by reference in its entirety.

EXAMPLE 2

Computational Identification of a Type VI-like Cas Ribonuclease Family

This example describes methods used to identify previously undetected or uncharacterized RNA-targeting CRISPR-Cas systems by developing a computational pipeline for class 2 CRISPR-Cas loci, which require only a single nuclease for CRISPR interference such as Cas9, Cas12a (formerly Cpf1), or Cas13a (formerly C2c2) (Makarov et al., 2015; Shmakov et al., 2015). To improve upon previous strategies for bioinformatic mining of CRISPR systems, which focus on discovering sets of conserved Cas genes involved in spacer acquisition (Shmakov et al., 2015), the minimal requirements for a CRISPR locus to be the presence of a CRISPR repeat array and a nearby effector nuclease were defined. Using the CRISPR array as a search anchor, all prokaryotic genome assemblies and scaffolds were obtained from the NCBI WGS database and adapted algorithms for de novo CRISPR array detection (Bland et al., 2007; Edgar, 2007; Grissa et al., 2007) to identify 21,175 putative CRISPR repeat arrays (FIG. 1A).

Up to 20 kilobases (kb) of genomic DNA sequence flanking each CRISPR array was extracted to identify predicted protein-coding genes in the immediate vicinity. Candidate loci containing signature genes of known class 1 and class 2 CRISPR-Cas systems such as Cas3 or Cas9 were excluded from further analysis, except for Cas12a and Cas13a to judge the ability of the pipeline to detect and cluster these known class 2 effector families. To identify new class 2 Cas effectors, it was required that candidate proteins be >750 residues in length and within 5 protein-coding genes of the repeat array, as large proteins closely associated with CRISPR repeats are key characteristics of known single effectors. The resulting proteins were classified into 408 putative protein families using single-linkage hierarchical clustering based on homology.

To discard protein clusters that reside in close proximity to CRISPR arrays due to chance or overall abundance in the genome, additional homologous proteins to each cluster were identified from the NCBI non-redundant protein database and their proximity to a CRISPR array determined. Reasoning that true Cas genes would have a high co-occurrence rate with CRISPR repeats, >70% of the proteins for each expanded cluster were required to exist within 20 kb of a CRISPR repeat. These remaining protein families were analyzed for nuclease domains and motifs.

Figure 2A:
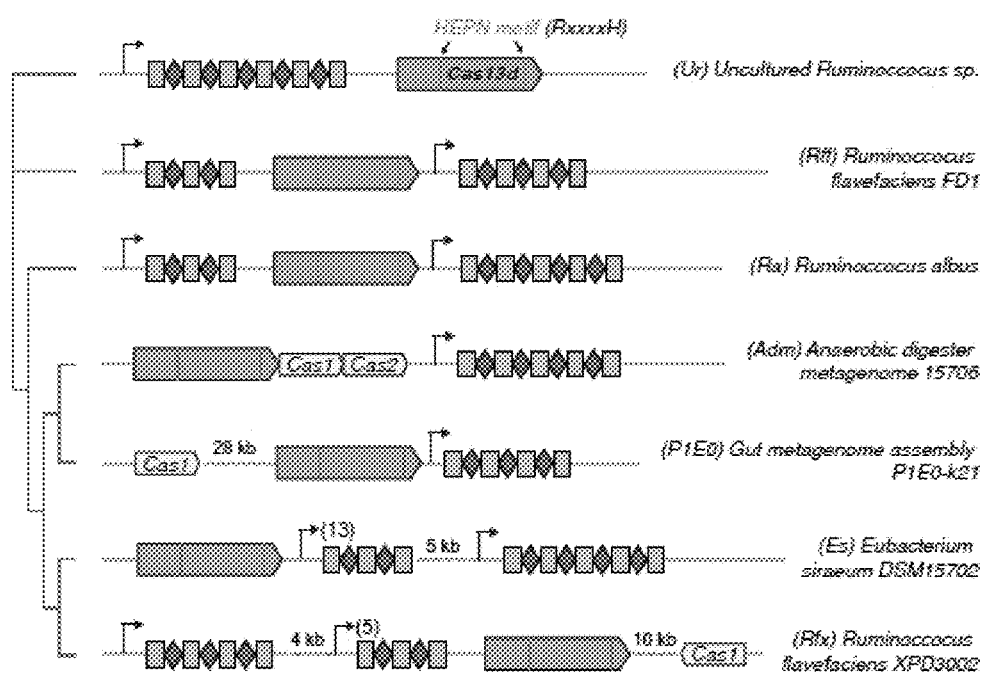
FIGS. 2A-2C: Type VI CRISPR-Cas13d is a family of single effector CRISPR ribonucleases. (A) Maximum-likelihood phylogenetic tree of Cas13d effectors used herein, with the full Cas13d CRISPR locus depicted along with conserved HEPN RNase domains. Grey rectangles denote CRISPR direct repeats (DRs) and blue diamonds indicate spacer sequences. (B) RNA sequencing of a heterologously expressed Cas13d locus from an uncultured *Ruminococcus* sp. sample. Mature gRNAs mapping to the CRISPR array indicate a processed 30 nt DR and a variable spacer length from 14-26 nt (SEQ ID NO: 278). Co-fold analysis of direct repeat truncation indicates a strong hairpin structure. (C) Purified *E. siraeum* Cas13d and catalytically dead Cas13d (dCas13d) protein are each sufficient to process a guide array into its two component gRNAs. Addition of EDTA does not impair gRNA processing. 'd,', dCas13d (R295A, H300A, R849A, H854A).
Figure 3A:
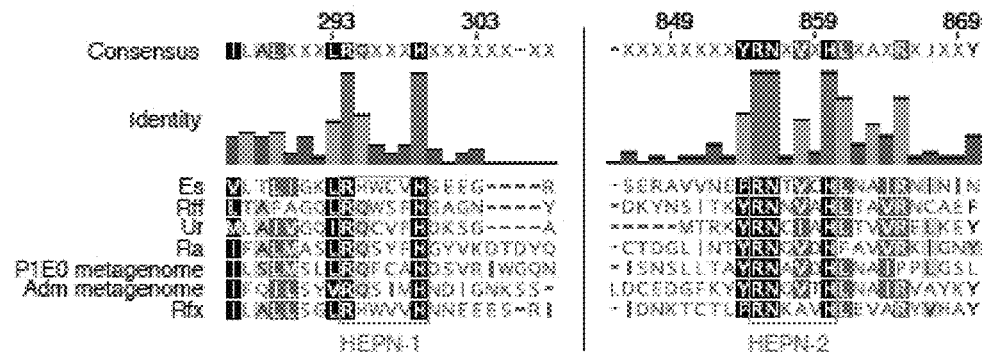
FIGS. 3A-3D. Phylogenetic classification of RNA-targeting class 2 CRISPR effectors and sequence conservation within the Cas13d family. (A) HEPN motif conservation in Cas13d effectors used herein with conserved residues shaded according to Blosum62. Consensus sequence of HEPN1 domain region (SEQ ID NO: 279) and alignment of HEPN1 domain region of seven Cas13d proteins (SEQ ID NOS: 280 to 286). Consensus sequence of HEPN2 domain region (SEQ ID NO: 287) and alignment of HEPN2 domain region of seven Cas13d proteins (SEQ ID NOS: 288 to 294). The RxxxxH HEPN motif is highlighted. (B) Maximum-likelihood tree of type VI CRISPR-Cas families. Average amino acid lengths of Type VI Cas13 superfamily effectors are indicated in red. Alignment of previously described class 2 CRISPR RNA-targeting proteins (Abudayyeh et al., 2017; Cox et al., 2017; East-Seletsky et al., 2017; East-Seletsky et al., 2016; Smargon et al., 2017) and Cas13d effectors was performed using MAFFT 7.38 and maximum-likelihood tree building was performed with PhyML 3.2. Branch labels and scale bar indicate substitutions per site. (C) Predicted Cas13d direct repeat RNA secondary structure. (D) Sequence logo of full length 36 nt Cas13d direct repeats.
Figure 3B:
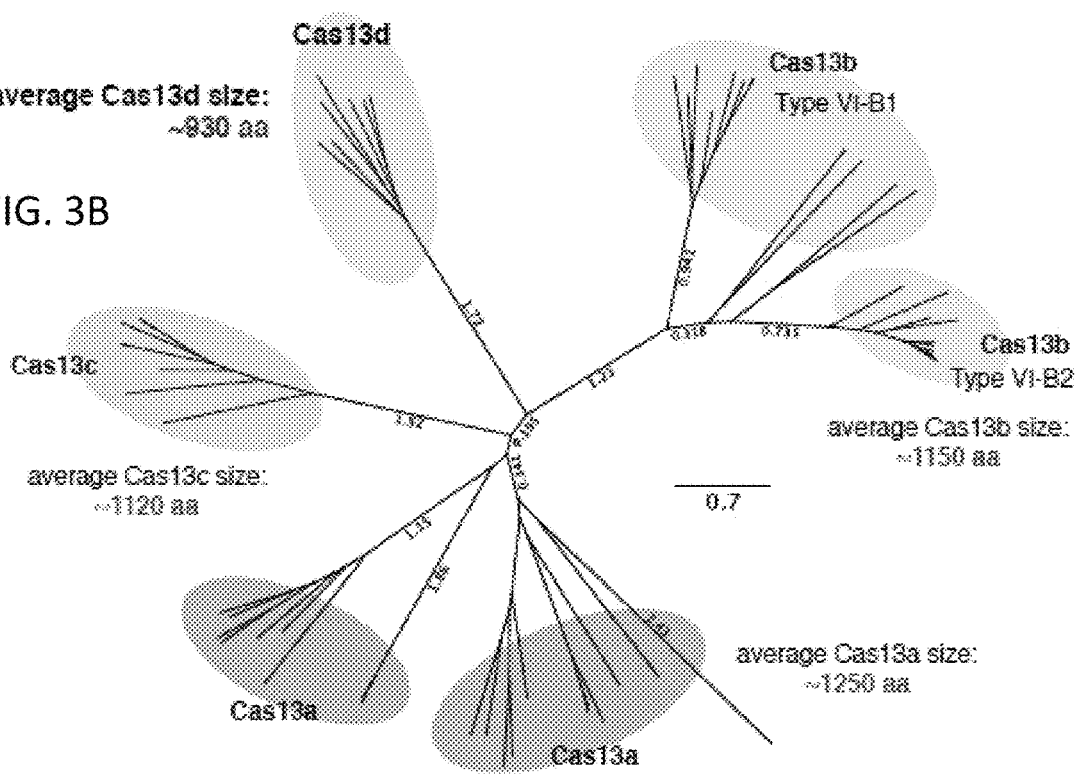

Among the candidates, which include the recently described Cas13b system (Smargon et al., 2017), a family of uncharacterized putative class 2 CRISPR-Cas systems encoding a candidate CRISPR-associated ribonuclease containing 2 predicted HEPN ribonuclease motifs (Anantharaman et al., 2013) were identified (FIG. 2A). Importantly, they are among the smallest class 2 CRISPR effectors described to date (~930 aa). The Type VI CRISPR-Cas13 superfamily is exemplified by sequence-divergent, single-effector signature nucleases and the presence of two HEPN domains. Other than these two RxxxxH HEPN motifs (FIG. 3A), the candidate effectors have no significant sequence similarity to previously described Cas13 enzymes, so his family of putative CRISPR ribonucleases is designated as Type VI Cas13d, or Type VI-D (FIG. 3B).

Figure 1B:
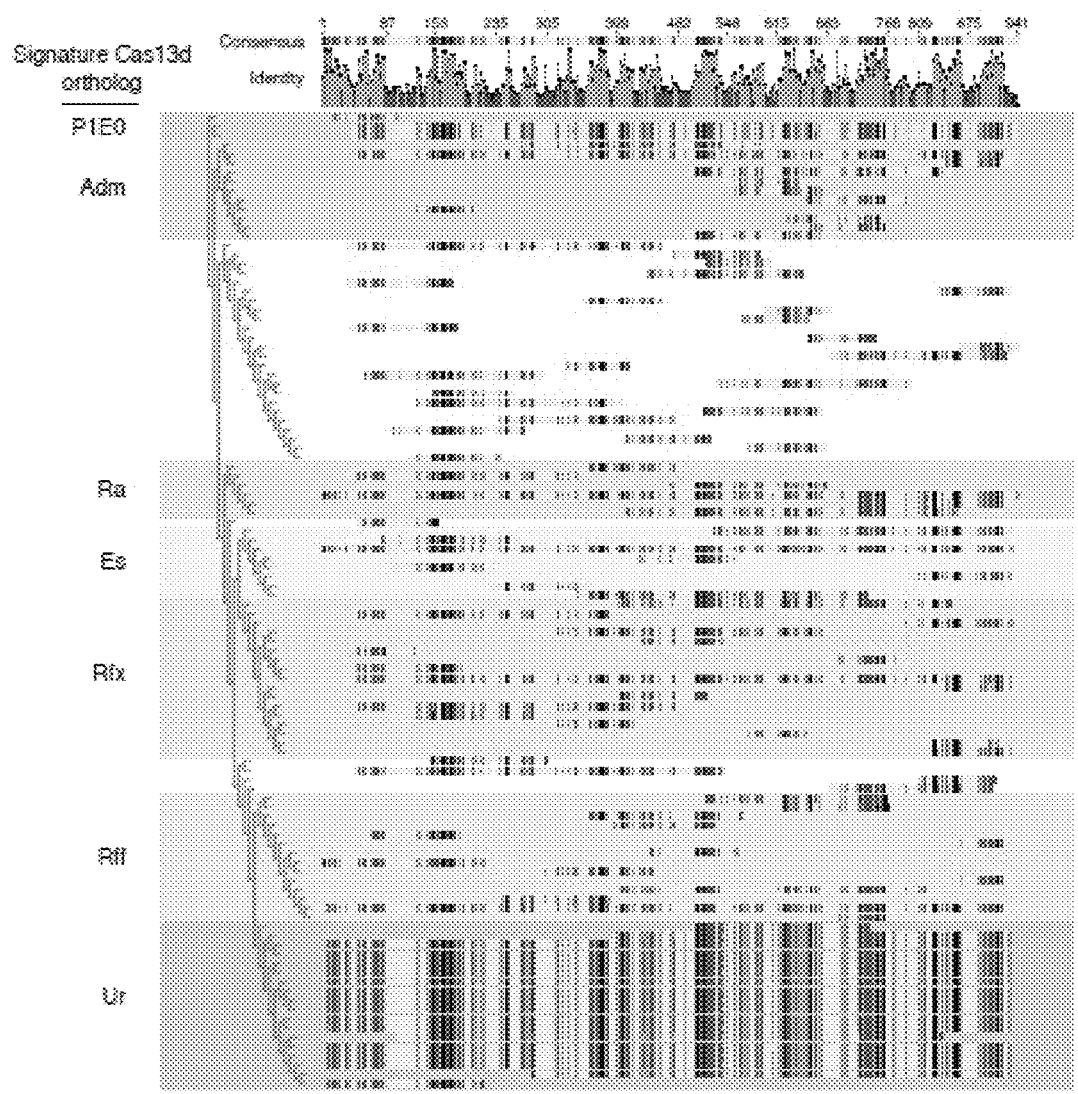

CRISPR-Cas13d systems are derived from gut-resident microbes, so we sought to expand the Cas13d family via alignment to metagenomic contigs from recent large-scale microbiome sequencing efforts. Comparison of Cas13d proteins against public metagenome sequences without predicted open reading frames (ORFs) identified additional full-length systems as well as multiple effector and array fragments that cluster in several distinct branches (FIG. 1B). To generate full-length Cas13d ortholog proteins and loci from the different branches of the Cas13d protein family, genomic DNA samples we43 obtained from associated assemblies and performed targeted Sanger sequencing to fill in gaps due to incomplete sequencing coverage, such as for the metagenomic ortholog 'Anaerobic digester metagenome' (Adm) (Treu et al., 2016).

Figures 3C, 3D:
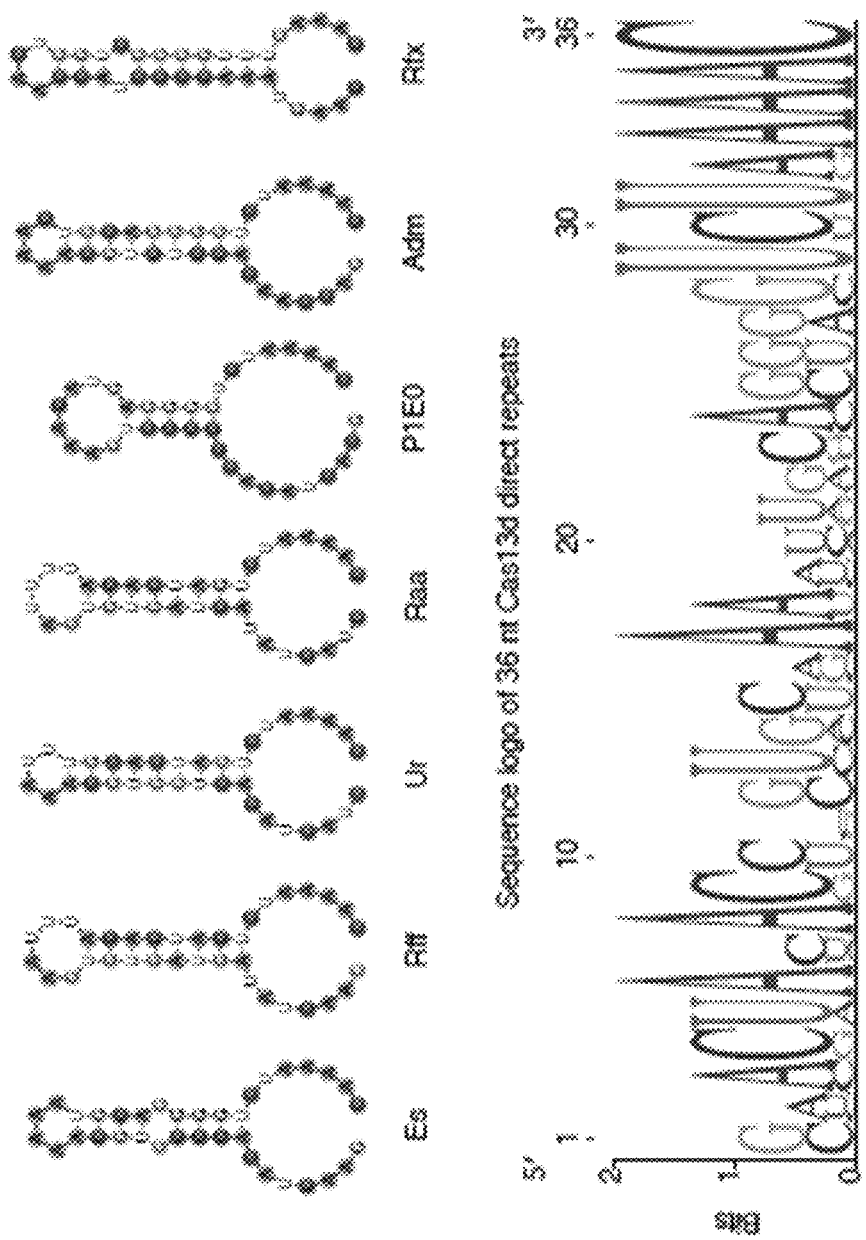

Cas13d CRISPR loci are largely clustered within benign, Gram-positive gut bacteria of the genus *Ruminococcus*, and exhibit a surprising diversity of CRISPR locus architectures (FIG. 2A). With the exception of the metagenomic AdmCas13d system, Cas13d systems lack the key spacer acquisition protein Cas1 (Yosef et al., 2012) within their CRISPR locus, highlighting the utility of a class 2 CRISPR discovery pipeline without Cas1 or Cas2 gene requirements. Cas13d direct repeats (DRs) are highly conserved in length and predicted secondary structure (FIG. 3C), with a 36 nt length, an 8-10 nt stem with A/U-rich loop, and a 5'-AAAAC motif at the 3' end of the direct repeat (FIG. 3D). This conserved 5'-AAAAC motif has been shown to be specifically recognized by a type II Cas1/2 spacer acquisition complex (Wright and Doudna, 2016). In fact, Cas1 can be found in relative proximity to some Cas13d systems (within 10-30 kb for P1E0 and Rfx) while the remaining Cas13d-containing bacteria contain Cas1 elsewhere in their genomes, likely as part of another CRISPR locus.

EXAMPLE 3

CRISPR-Cas13d Possesses Dual RNase Activities

Figure 2B:
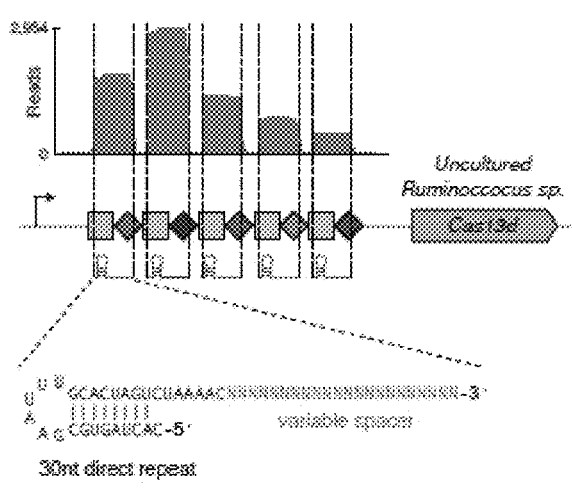

To demonstrate that the Cas13d repeat array is transcribed and processed into CRISPR guide RNAs (gRNA), the Cas13d CRISPR locus was cloned from an uncultured *Ruminococcus* sp. sample (Ur) into a bacterial expression plasmid. CRISPR systems tend to form self-contained operons with the necessary regulatory sequences for independent expression, facilitating heterologous expression in *E. coli* (Gasiunas et al., 2012). RNA sequencing (Heidrich et al., 2015) revealed processing of the array into ~52 nt mature gRNAs, with a 30 nt 5' direct repeat followed by a variable 3' spacer that ranged from 14-26 nt in length (FIG. 2B).

Figure 2C:
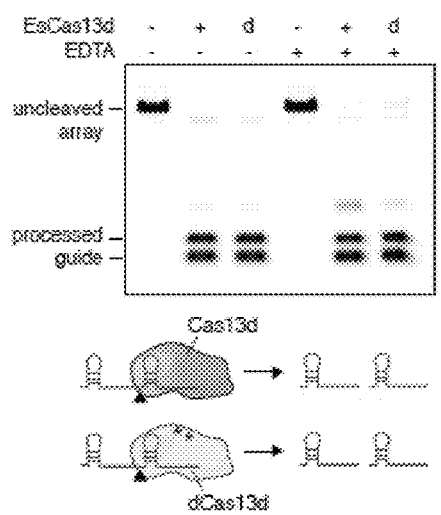

To characterize Cas13d properties in vitro, *Eubacterium siraeum* Cas13d protein (EsCas13d) was purified based on its robust recombinant expression in *E. coli* (FIGS. 4A-4C) and found that EsCas13d was solely sufficient to process its matching CRISPR array into constituent guides without additional helper ribonucleases (FIG. 2C, Table S1 of Konermann et al., "Transcriptome Engineering with RNA-Targeting Type VI-D CRISPR Effectors," Cell 173:1-12, 2018, herein incorporated by reference in its entirety), a property shared by some class 2 CRISPR-Cas systems (East-Seletsky et al., 2016; Fonfara et al., 2016; Smargon et al., 2017). Furthermore, inactivating the positively charged catalytic residues of the HEPN motifs (Anantharaman et al., 2013) (dCas13d: R295A, H300A, R849A, H854A) did not affect array processing, indicating a distinct RNase activity dictating gRNA biogenesis analogous to Cas13a (East-Seletsky et al., 2016; Liu et al., 2017).

Cas effector proteins typically form a binary complex with mature gRNA to generate an RNA-guided surveillance ribonucleoprotein capable of cleaving foreign nucleic acids for immune defense (van der Oost et al., 2014). To assess if Cas13d has programmable RNA targeting activity as indicated by the presence of two HEPN motifs, EsCas13d protein was paired with an array or a mature gRNA along with a cognate in vitro-transcribed target. Based on the RNA sequencing results, a mature gRNA containing a 30 nt direct repeat and an intermediate spacer length of 22 nt was selected (nucleotides 6-36 of SEQ ID NO: 129, followed by 22 bases complementary to the RNA target).

Figure 5A:
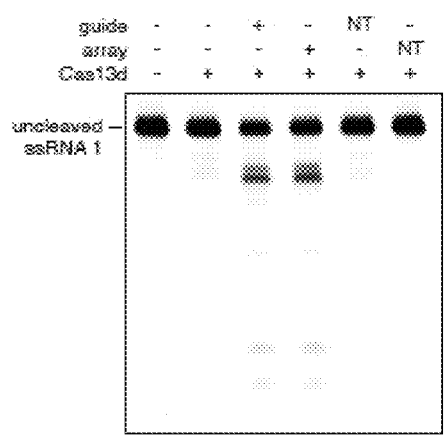
FIGS. 5A-5D: Programmable RNA targeting by Cas13d in vitro. (A) *E. siraeum* Cas13d requires a matching guide array or mature gRNA to efficiently cleave complementary ssRNA targets. Denaturing gel depicts cleavage reactions incubated at 37° C. for 1 hour. NT, non-targeting. (B) Substitution with dCas13d or addition of EDTA abrogate Cas13d-mediated RNA targeting with both the guide and array. 'd', dead Cas13d. (C) Denaturing gel depicting guide-target match dependent activation of Cas13d cleavage activity. Scrambled target RNA ('A') is fluorescently labeled, while guide-complementary activator target RNA ('B') is unlabeled. RNA cleavage activity is abolished by the individual removal of guide RNA or complementary target RNA, as well as the addition of EDTA or the catalytic inactivation of Cas13d (indicated as 'd'). (D) A model for guide and target-dependent activation of Cas13d RNase activity. The ternary Cas13d:gRNA:target RNA complex is capable of cleaving the complementary target RNA or bystander RNAs.
Figure 5B:
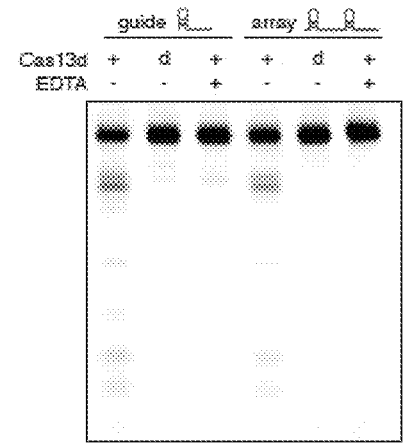
Figure 6A:
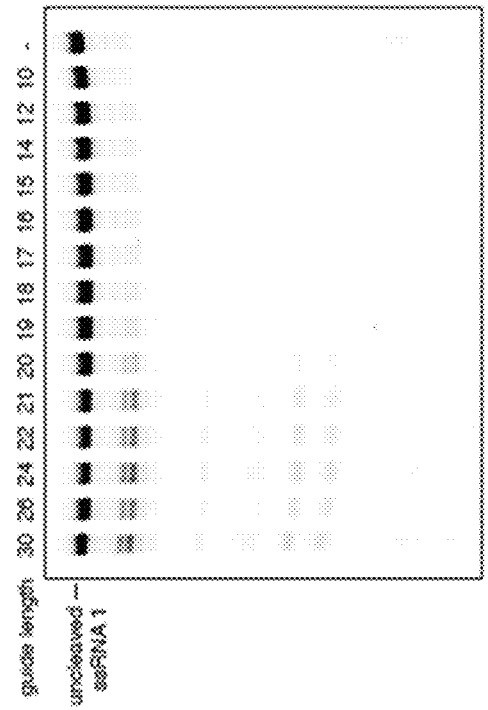
Figure 6B:
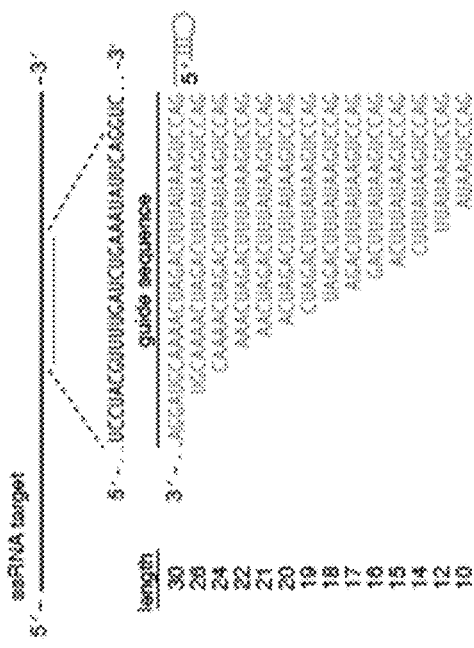

Cas13d was able to efficiently cleave the complementary target ssRNA with both the unprocessed array and mature gRNA in a guide-sequence dependent manner, while non-matching spacer sequences abolished Cas13d activity (FIG. 5A). Substitution with dCas13d or the addition of EDTA to the cleavage reaction also abolished guide-dependent RNA targeting, indicating that Cas13d targeting is HEPN- and $Mg^{2+}$-dependent (FIG. 5B). To determine the minimal spacer length for efficient Cas13d targeting, a series of spacer truncations ranging from the unprocessed 30 nt length down to 10 nt were generated (FIG. 6A). Cleavage activity dropped significantly below a 21 nt spacer length, confirming the choice of a 22 nt spacer (FIG. 6B).

RNA-targeting class 2 CRISPR systems have been proposed to act as sensors of foreign RNAs (Abudayyeh et al., 2016; East-Seletsky et al., 2016), where general RNase activity of the effector nuclease is triggered by a guide-matching target. To assay for a similar property in Cas13d, RNase activity of the binary EsCas13d:gRNA complex was monitored in the presence of a matching RNA target. It was observed that EsCas13d can be activated by target RNA to cleave bystander RNA targets (FIG. 3C), albeit inefficiently relative to its activity on the complementary ssRNA target. Bystander cleavage is guide sequence- and HEPN-dependent, as the presence of non-matching bystander target alone was insufficient to induce cleavage while substitution of dCas13d or addition of EDTA abolished activity. These results indicate that bystander RNase activity may be a general property of RNA-targeting class 2 systems in CRISPR adaptive bacterial immunity (FIG. 3D).

Figure 6C:
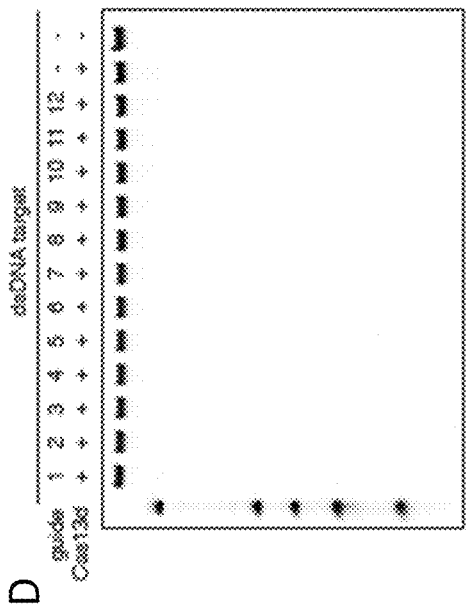
Figure 6D:
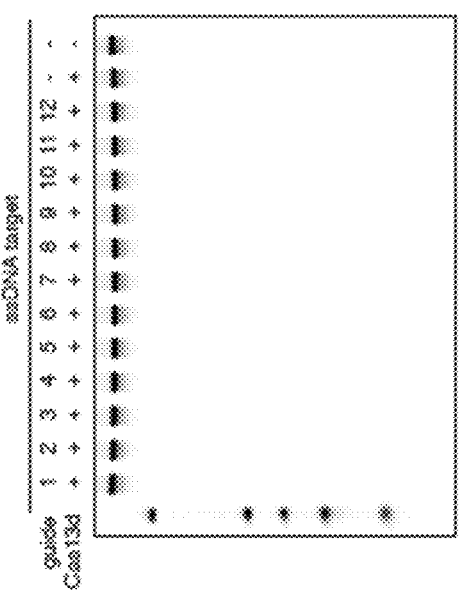
Figure 7A:
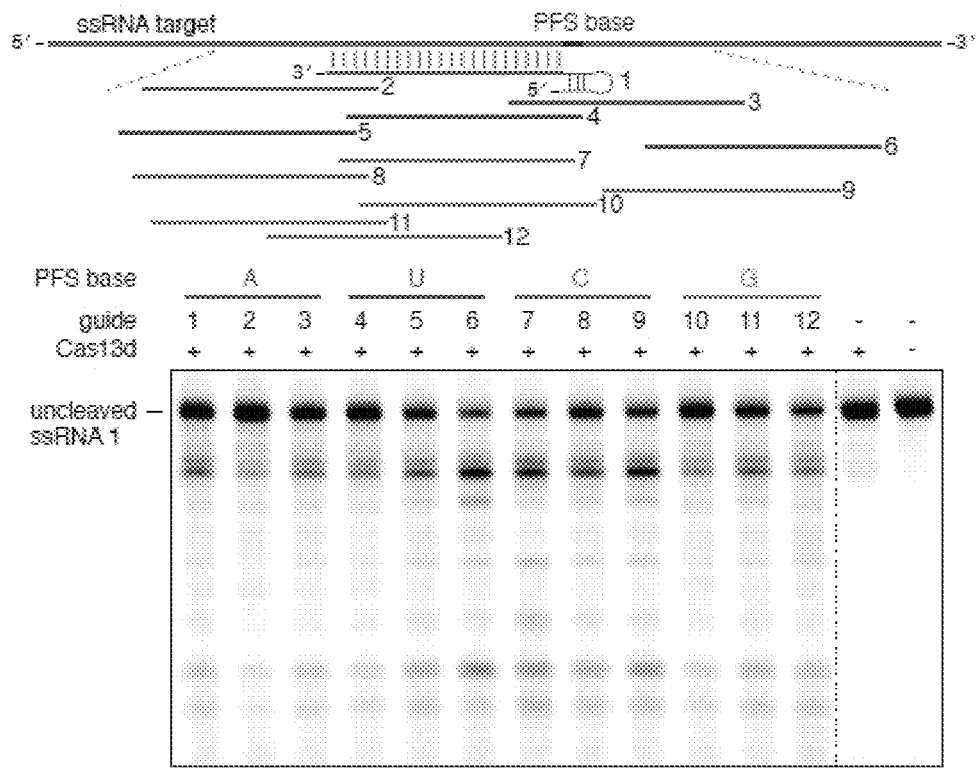
FIGS. 7A-7B: Characterization of Cas13d target substrate preference. (A) Cas13d can be generalizably reprogrammed with multiple guides and does not exhibit a protospacer flanking sequence (PFS) requirement. RNA cleavage by EsCas13d and 12 guides tiling the target RNA is shown. Control lanes are from a separate gel run in parallel. (B) Cas13d preferentially cleaves uracil bases in the loop of a hairpin or a linear homopolymer repeat, which is interrupted every 5 nt by a transition mutation (X) to enable synthesis.

To assess the generalizability of Cas13d reprogramming, twelve guides tiling a complementary RNA target were generated and efficient cleavage in all cases was observed (FIG. 7A). Cas13d was unable to cleave a ssDNA (FIG. 6C) or dsDNA (FIG. 6D) version of the ssRNA target, indicating that Cas13d is an RNA-specific nuclease. Further, RNA target cleavage did not depend on the protospacer flanking sequence (PFS) (FIG. 7A) in contrast to other RNA-targeting class 2 systems, which require a 3'-H (Abudayyeh et al., 2016) or a double-sided, DR-proximal 5'-D and 3'-NAN or NNA (Smargon et al., 2017). Although a slight bias against an adenine PFS was initially observed (FIG. 6E), varying the target PFS base with a constant guide sequence resulted in no significant differences (P=0.768) in targeting efficiency (FIG. 6F).

Figure 5C:
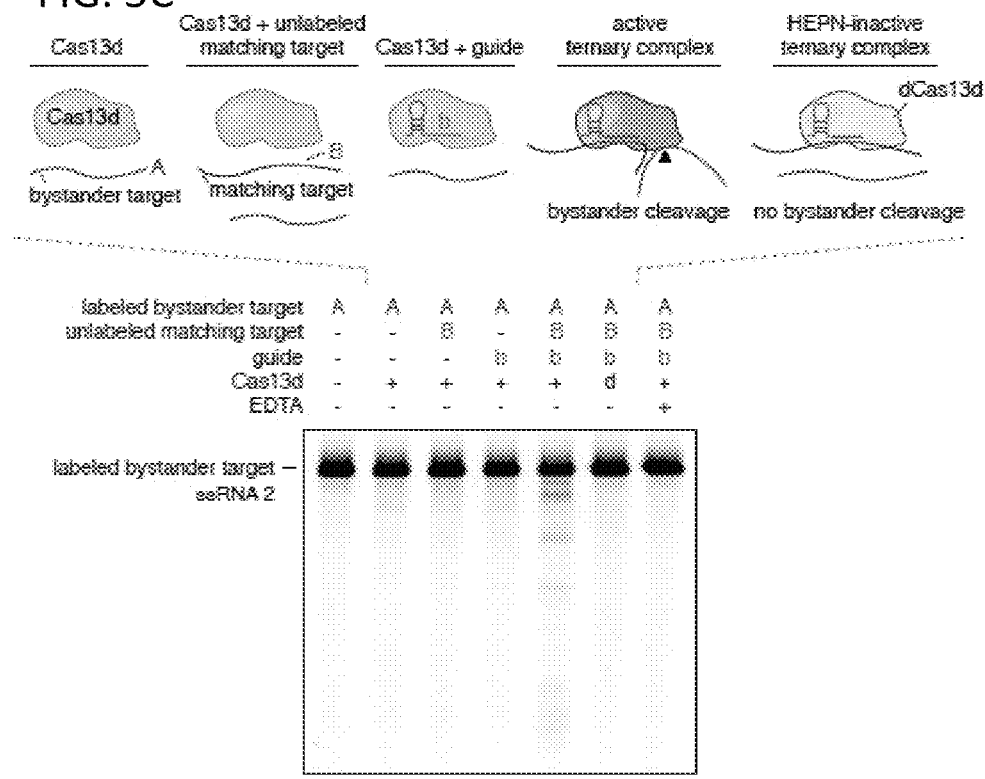
Figure 5D:
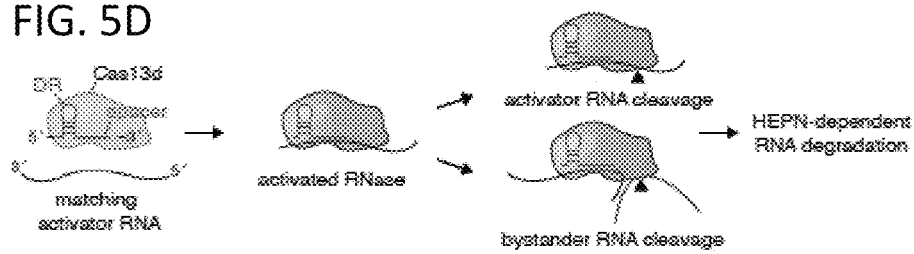
Figure 7B:
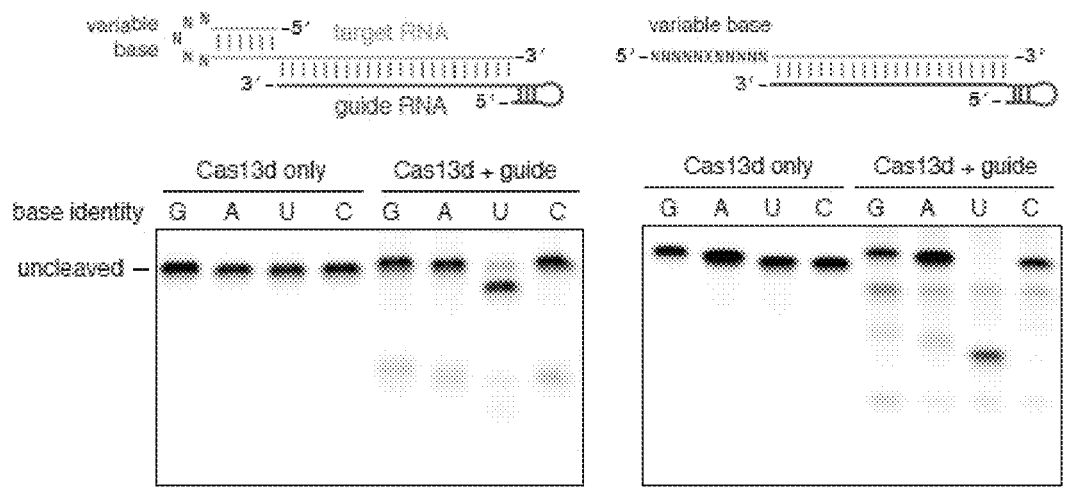

While DNA-targeting class 2 CRISPR systems (Gasiunas et al., 2012; Jinek et al., 2012; Zetsche et al., 2015) and some RNA-targeting class 1 systems tend to cleave at defined positions relative to the target-guide duplex (Samai et al., 2015; Zhang et al., 2016), the Cas13d cleavage pattern varies for different targets (FIGS. 5A, 5C, 6H) and remains remarkably similar despite the guide sequence position (FIG. 7A). This indicates that Cas13d may preferentially cleave specific sequences or structurally accessible regions in the target RNA. Cas13d was tested activity on targets containing variable homopolymer repeats in the loop region of a hairpin or as a linear single-stranded repeat. EsCas13d exhibited significant preference for uracil bases in both target structures, with lower but detectable activity at all other bases (FIG. 7B).

Cas enzymes are found in nearly all archaea and about half of bacteria (Hsu et al., 2014; van der Oost et al., 2014), spanning a wide range of environmental temperatures. To determine the optimal temperature range for Cas13d activity, a spectrum of cleavage temperature conditions from 16-62° C. was tested and observed maximal activity in the 24-41° C. range (FIGS. 6G, 6H). This temperature range is compatible with a wide range of prokaryotic and eukaryotic hosts, indicating Cas13d can be adapted for RNA targeting in different cells and organisms.

EXAMPLE 4

Cell-based Activity Screen of Engineered Orthologs

The Cas13d nuclease was used as a flexible tool for programmable RNA targeting in mammalian cells. CRISPR orthologs from distinct bacterial species commonly exhibit variable activity (Abudayyeh et al., 2017; East-Seletsky et al., 2017), especially upon heterologous expression in human cells (Ran et al., 2015; Zetsche et al., 2017). Highly active Cas13d orthologs were identified in a eukaryotic cell-based mCherry reporter screen.

By synthesizing human codon-optimized versions of 7 orthologs from distinct branches within the Cas13d family (FIG. 1B), mammalian expression plasmids carrying the catalytically active and HEPN-inactive proteins were generated. Each protein was then optionally fused to N- and C-terminal nuclear localization signals (NLS). These Cas13d effector designs were HA-tagged and paired with two distinct guide RNA architectures, either with a 30 nt spacer flanked by two direct repeat sequences to mimic an unprocessed guide RNA (pre-gRNA) or a 30 nt direct repeat with 22 nt spacer (gRNA) predicted to mimic mature guide RNAs (FIG. 8A). For each guide design, four distinct spacer sequences complementary to the mCherry transcript were then pooled to minimize potential spacer-dependent variability in targeting efficiency. The ability of Cas13d to knockdown mCherry protein levels was determined in a human embryonic kidney (HEK) 293FT cell-based reporter assay.

48 hours post-transfection, flow cytometry indicated that RfxCas13d and AdmCas13d efficiently knocked down mCherry protein levels by up to 92% and 87% (P<0.0003), respectively, relative to a non-targeting control guide (FIG. 8B). In contrast, EsCas13d along with RaCas13d and RffCas13d exhibited limited activity in human cells. Furthermore, none of the HEPN-inactive Rfx-dCas13d constructs significantly affected mCherry fluorescence, indicating HEPN-dependent knockdown (P>0.43 for all cases). Robust nuclear translocation of the Rfx and AdmCas13d NLS fusion constructs was observed via immunocytochemistry, while the wild-type effectors remain primarily extra-nuclear (FIG. 8C).

Proceeding with RfxCas13d and AdmCas13d as lead candidates, we next compared their ability to knockdown endogenous transcripts. To determine the optimal ortholog and guide architecture, the capability of Rfx and AdmCas13d construct variants to target β-1,4-N-acetyl-galactosaminyl transferase 1 (B4GALNT1) transcripts was systematically assayed. In each condition, four guides containing distinct spacer sequences tiling the B4GALNT1 transcript were pooled. The RfxCas13d-NLS fusion targeted B4GALNT1 more efficiently than wild-type RfxCas13d and both variants of AdmCas13d, with both the gRNA and pre-gRNA mediating potent knockdown (~82%, P<0.0001) (FIG. 8D). Cas13d-NLS from *Ruminococcus flavefaciens* strain XPD3002 was therefore selected for the remaining experiments (CasRx).

EXAMPLE 5

Programmable RNA Knockdown in Human Cells with CasRx

Because Cas13d is capable of processing its own CRISPR array, this property was leveraged for the simultaneous delivery of multiple targeting guides in a simple single-vector system (FIG. 9A). Arrays encoding four spacers that each tile the transcripts of mRNAs (B4GALNT1 and ANXA4) or nuclear localized lncRNAs (HOTTIP and MALAT1) consistently facilitated robust (>90%) RNA knockdown by CasRx (P<0.0001) (FIG. 9B).

CasRx was compared to more established technologies for transcript knockdown or repression, by comparing CasRx-mediated RNA interference to dCas9-mediated CRISPR interference (Gilbert et al., 2014; Gilbert et al., 2013) and spacer sequence-matched shRNAs via transient transfection (FIG. 9C). For CRISPRi-based repression, the most potent dCas9 guide for B4GALNT1 from previous reports was analyzed (Gilbert et al., 2014; Zalatan et al., 2015). Across 3 endogenous transcripts, CasRx outperformed shRNAs (11/11) and CRISPRi (4/4) in each case (FIG. 9D), exhibiting a median knockdown of 96% compared to 65% for shRNA and 53% for CRISPRi after 48 hours. In addition, knockdown by CasRx was compared to two recently described Cas13a and Cas13b effectors (Abudayyeh et al., 2017; Cox et al., 2017) (FIG. 10A). Across three genes and eight guide RNAs, CasRx mediated significantly greater transcript knockdown than both LwaCas13a-msfGFP-NLS and PspCas13b-NES (median: 97% compared to 80% and 66% respectively, P<0.0001) (FIG. 10B).

Figures 9E, 9F, 9G, 9H:
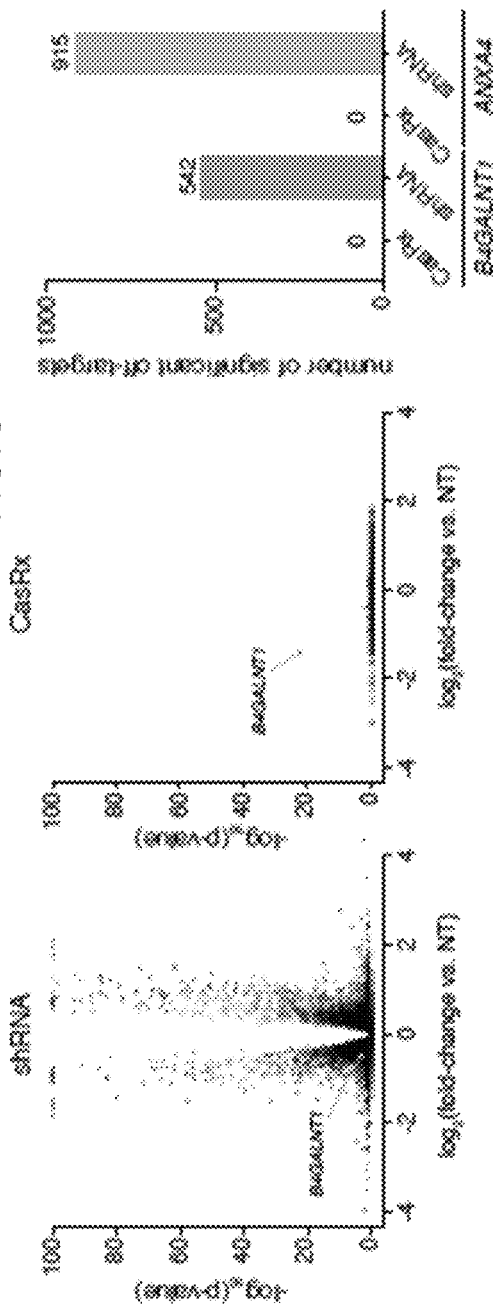
Figure 11A:
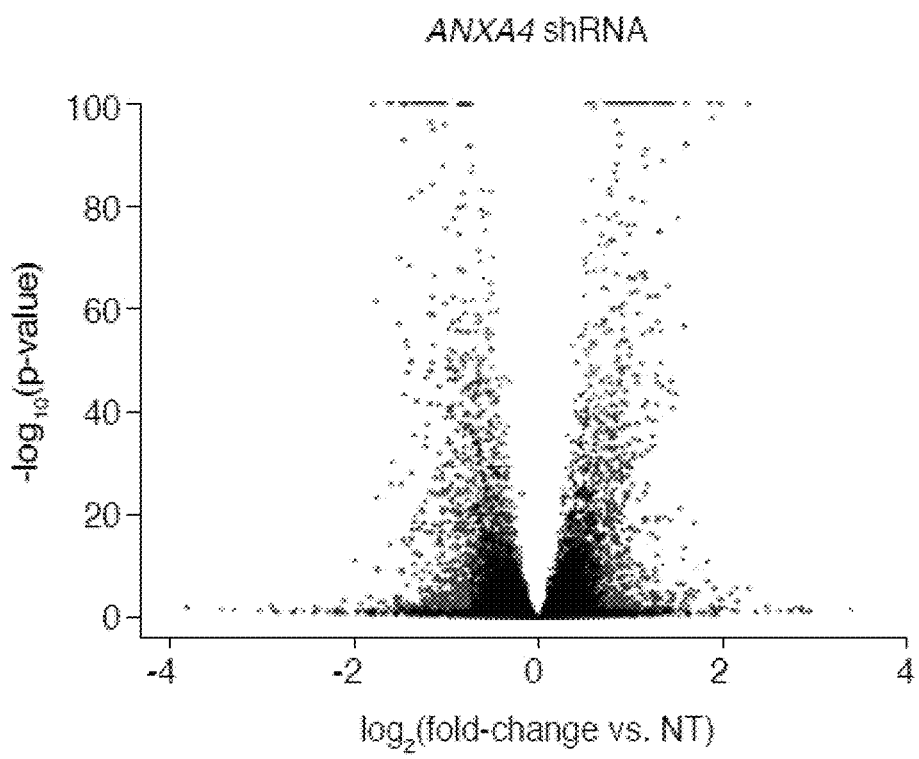
FIGS. 11A-11B. RNA sequencing from CasRx and shRNA targeting of ANXA4 in human cells. (A) Volcano plots of differential transcript levels between ANXA4 targeting and non-targeting (NT) shRNAs as determined by RNA sequencing (n=3). 915 non-specific transcript changes were identified. (B) Volcano plot of differential transcript levels for an ANXA4 targeting CasRx array used in FIG. 9B containing a guide position matched to the shRNA shown in (A) and a non-targeting (NT) array. ANXA4 was the only transcript exhibiting significant downregulation with n=3. HIST2HBE was the only transcript identified to exhibit significant upregulation. H2B is a dimer partner of H2AX (Du et al., 2006) which has been shown to interact with ANXA4 (Yang et al., 2010).
Figure 11B:
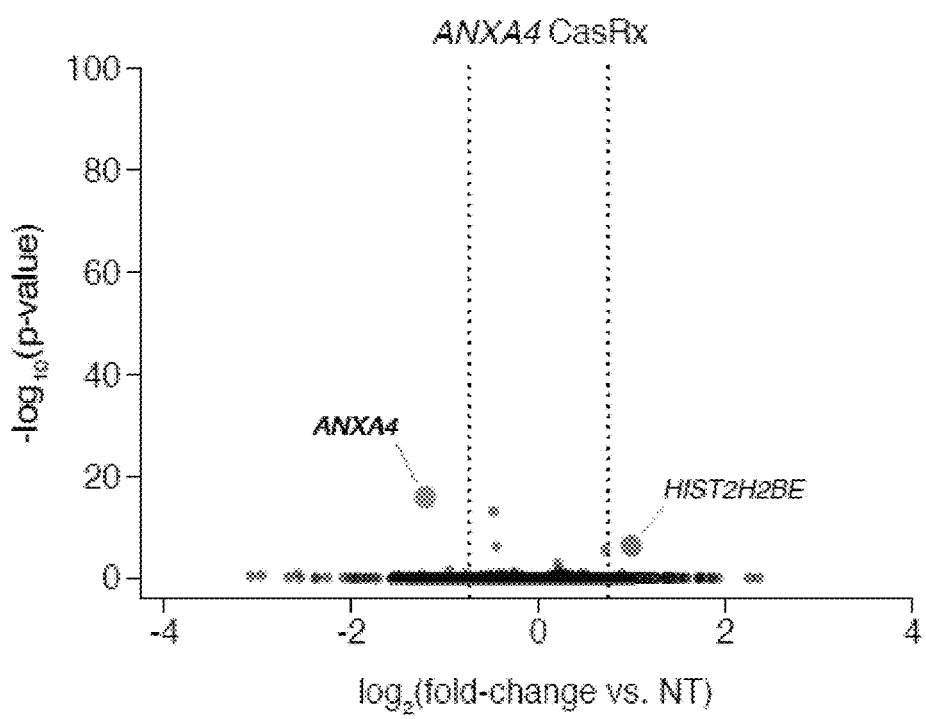

RNAi has been widely used to disrupt any gene of interest due to a combination of simple re-targeting principles, scalable synthesis, knockdown potency, and ease of reagent delivery. However, widespread off-target transcript silencing has been a consistent concern (Jackson et al., 2003; Sigoillot et al., 2012), possibly due to the entry of RNAi reagents into the endogenous miRNA pathway (Doench et al., 2003; Smith et al., 2017). Consistent with these reports, upon RNA sequencing of human cells transfected with a B4GALNT1-targeting shRNA, widespread off-target transcriptional changes relative to a non-targeting shRNA were observed (>500 significant off-target changes, P<0.01, FIGS. 9E, 9G). In contrast, transcriptome profiling of spacer-matched CasRx guide RNAs revealed no significant off-target changes other than the targeted transcript (FIG. 9F). This indicates that the moderate bystander cleavage observed in vitro (FIG. 5C) may not result in observable off-target transcriptome perturbation in mammalian cells. A similar pattern was observed when targeting ANXA4 (FIGS. 11A-11B), with over 900 significant off-target changes resulting from shRNA targeting compared to zero with CasRx (FIG. 9G).

To confirm that CasRx interference is broadly applicable, a panel of 11 additional genes with diverse roles in cancer, cell signaling, and epigenetic regulation were selected and 3 guides per gene were screened. CasRx consistently mediated high levels of transcript knockdown across genes with a median reduction of 96% (FIG. 9H). Each tested guide mediated at least 80% knockdown, underscoring the consistency of the CasRx system for RNA interference.

EXAMPLE 6

Splice Isoform Engineering with dCasRx

The experiments on RNA targeting with CasRx revealed that target RNA and protein knockdown is dependent on the catalytic activity of the HEPN domains (FIGS. 8B, 5B). The same guide sequences mediating efficient knockdown with CasRx failed to significantly reduce mCherry levels when paired with catalytically inactive dCasRx (FIG. 8B), indicating that targeting of dCasRx to the coding portion of mRNA does not necessarily perturb protein translation. This observation indicated the possibility of utilizing dCasRx for targeting of specific coding and non-coding elements within a transcript to study and manipulate RNA. To validate this concept, the utility of the dCasRx system was expanded by creating a splice effector.

Figure 12A:
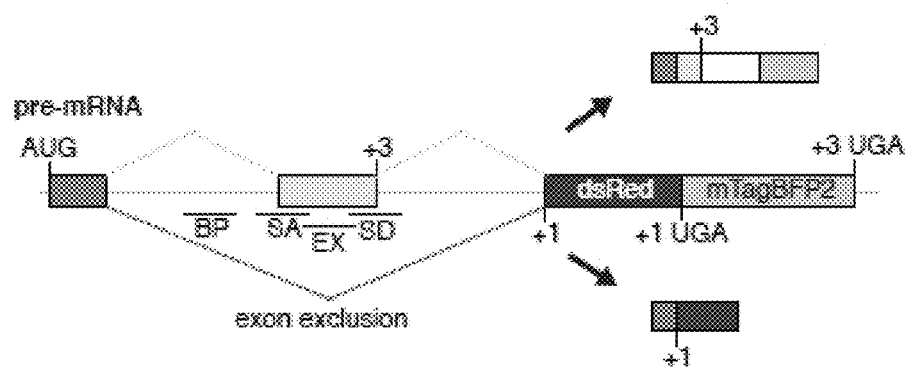
FIGS. 12A-12F: AAV delivery of catalytically inactive dCasRx splice effectors to manipulate alternative splicing. (A) Schematic of bichromatic exon skipping reporter. +1 and +3, reading frame. BP, intronic branch point-targeting guide. SA, splice acceptor site-overlapping guide. EX, exonic guide. SD, splice donor site-overlapping guide. AUG, start codon. UGA, stop codon. Inclusion of the second exon leads to an out-of-frame (+3), non-fluorescent translation of dsRed followed by in-frame mTagBFP2. Exclusion of the targeted exon leads to an in frame translation of dsRed (+1) followed by a stop codon. (B) Induced exon exclusion by dCasRx and an N-terminal hnRNPa1-dCasRx fusion protein targeted to pre-mRNA. The Gly-rich C-terminal domain of hnRNPa1 is used as the effector domain. Exon skipping efficiency is depicted as a relative percentage of cells carrying primarily the dsRed or BFP isoform, determined through flow cytometry. NLS, nuclear localization signal. 'A', CRISPR array carrying all 4 guides. Values are mean±SEM with n=3. (C) AAV design carrying dCasRx and a three-guide array with total transgene size <4.3 kb, including AAV inverted terminal repeats (ITRs). (D) Schematic of frontotemporal dementia (FTD) disease modeling. Neurons are generated via Neurogenin-2 (Ngn2) directed differentiation of patient-derived and control iPSCs followed by transduction with dCasRx or vehicle control AAV (EFS-mTagBFP2). (E) FTD is associated with SNPs in a putative intronic splice enhancer following exon 10 of the MAPT transcript encoding for tau. Alternative splicing of MAPT exon 10 results in 4R tau (by inclusion) and 3R tau (by exclusion). SNPs in the intronic splice enhancer including the indicated IVS 10+16 mutation result in increased exon inclusion and higher levels of 4R tau. To facilitate reduction of 4R tau levels, gRNAs contained in a dCasRx array were targeted to the exon 10 splice acceptor (g1) as well as two putative exonic splice enhancers indicated in purple (g2, g3). (F) Relative 4R/3R tau transcript ratios in differentiated neurons were assayed via qPCR at 14 days following transduction with AAV. FTD, frontotemporal dementia cells carrying IVS 10+16. Values are mean±S.D. with n=3. **** indicates P<0.0001.

Alternative splicing is generally regulated by the interaction of cis-acting elements in the pre-mRNA with positive or negative trans-acting splicing factors, which can mediate exon inclusion or exclusion (Matera and Wang, 2014; Wang et al., 2015). It was reasoned that dCasRx binding to such motifs may be sufficient for targeted isoform perturbation. For proof-of-concept, distinct splice elements were identified in a bichromatic splicing reporter containing DsRed upstream of mTagBFP2 in two different reading frames following an alternatively spliced exon (Orengo et al., 2006) (FIG. 12A). Inclusion or exclusion of this second exon toggles the reading frame and resulting fluorescence, facilitating quantitative readout of splicing patterns by flow cytometry. To mediate exon skipping, four guide RNAs were designed to target the intronic branchpoint nucleotide, splice acceptor site, putative exonic splice enhancer, and splice donor of exon 2.

One widespread family of negative splice factors are the highly conserved heterogeneous nuclear ribonucleoproteins (hnRNPs), which typically inhibit exon inclusion via a C-terminal, glycine-rich domain (Wang et al., 2015). The splicing reporter was targeted with dCasRx and engineered fusions to the Gly-rich C-terminal domain of hnRNPa1, one of the most abundant hnRNP family members (FIG. 12B).

Guide position appears to be a major determinant of the efficiency of engineered exon skipping. While each guide position mediated a significant increase in exon exclusion (P<0.0001 in all cases) relative to the non-targeting guide, targeting the splice acceptor resulted in the most potent exon exclusion (increase from 8% basal skipping to 65% for dCasRx alone and 75% with hnRNPa1 fusion). By comparison, dLwaCas13a-msfGFP-NLS mediated significantly lower levels of exon skipping across all four positions (19% skipping for splice acceptor guide) (FIGS. 10C and 10D, P<0.0001).

Figure 12B:
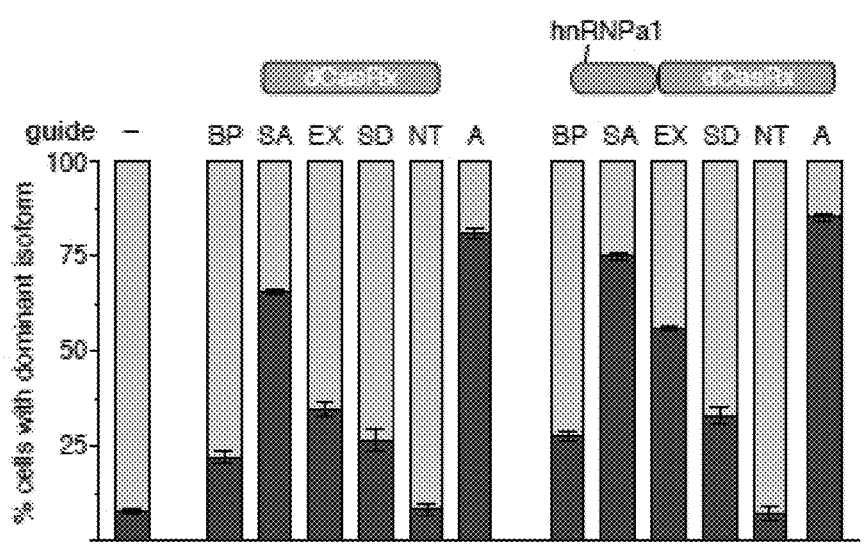

Targeting all 4 positions simultaneously with a CRISPR array achieved higher levels of exon skipping than individual guides alone (81% for dCasRx and 85% for hnRNPa1 fusion, P<0.006 compared to SA guide) (FIG. 12B). These results indicate that dCasRx allows for tuning of isoform ratios through varying guide placement and suggest that it can be leveraged as an efficient RNA binding module in human cells for targeting and manipulation of specific RNA elements.

EXAMPLE 7

Viral Delivery of dCasRx to a Neuronal Model of Frontotemporal Dementia

Figure 12C:
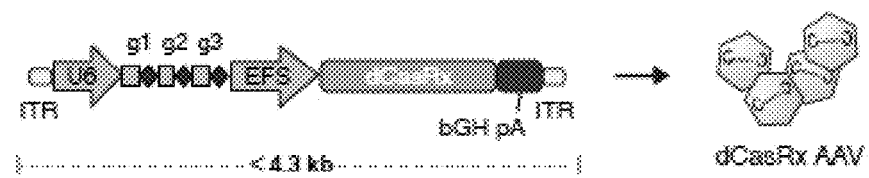

The Cas13d family averages 930 amino acids in length, in contrast to Cas9 (~1100 aa to ~1400 aa depending on subtype, with compact outliers such as CjCas9 or SaCas9), Cas13a (1250 aa), Cas13b (1150 aa), and Cas13c (1120 aa) (FIG. 3B) (Chylinski et al., 2013; Cox et al., 2017; Hsu et al., 2014; Kim et al., 2017; Shmakov et al., 2015; Smargon et al., 2017). Although adeno-associated virus (AAV) is a versatile vehicle for transgene delivery and gene therapy due to its broad range of capsid serotypes, low levels of insertional mutagenesis, and lack of apparent pathogenicity, its limited packaging capacity (~4.7 kb) makes it challenging to effectively deliver many single effector CRISPR enzymes (Abudayyeh et al., 2017; Ran et al., 2015; Swiech et al., 2015). The remarkably small size of Cas13d effectors render them uniquely suited for all-in-one AAV delivery with a CRISPR array, an optional effector domain, and requisite expression or regulatory elements (FIG. 12C).

Frontotemporal Dementia with Parkinsonism linked to Chromosome 17 (FTDP-17) is an autosomal dominant major neurodegenerative disease caused by diverse point mutations in MAPT, the gene encoding for tau. Tau exists as two major isoforms in human neurons, 4R and 3R, which are distinguished by the presence or absence of tau exon 10 and thus contain 4 or 3 microtubule binding domains. The balance of these two isoforms is generally perturbed in FTDP-17 as well as other tauopathies, driving the progression of neurodegeneration (Boeve and Hutton, 2008). Some forms of FTD are caused by mutations in the intron following MAPT exon 10 which disrupt an intronic splice silencer and elevate the expression of 4R tau (Kar et al., 2005), thereby inducing pathological changes (Schoch et al., 2016).

Figure 12D:
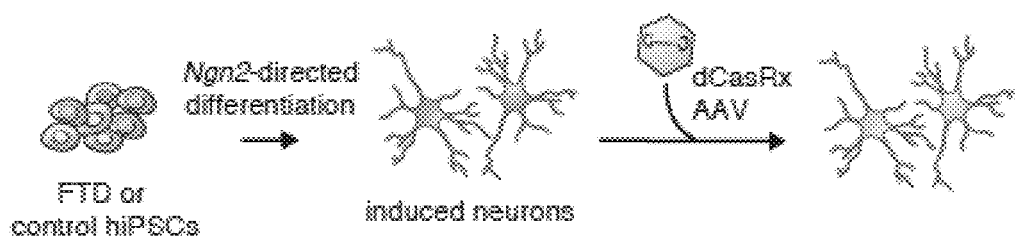
Figure 12E:
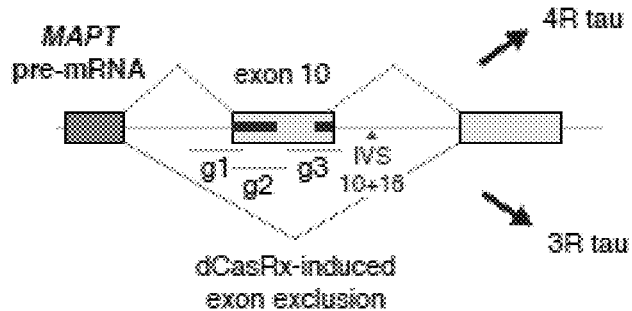
Figure 12F:
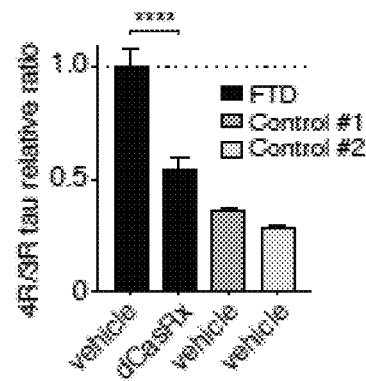

It was reasoned that dCasRx targeted to MAPT exon 10 could induce exon exclusion to alleviate dysregulated 4R/3R tau ratios. Patient-derived human induced pluripotent stem cells (hiPSCs) were differentiated into cortical neurons via Neurogenin-2 directed differentiation for 2 weeks (Zhang et al., 2013). Postmitotic neurons were then transduced with AAV1 carrying dCasRx (FIG. 12D) paired with a repeat array containing 3 spacers that target the exon 10 splice acceptor and two putative exonic splice enhancers (FIG. 12E). dCasRx-mediated exon exclusion was able to reduce the relative 4R/3R tau ratio by nearly 50% relative to a BFP vehicle control (FIG. 12F) and to a level similar to unaffected control neurons, demonstrating that CasRx can be exploited for transcriptional modulation in primary cell types via AAV delivery.

EXAMPLE 8

RNA Targeting in Human Cells Using Cas13d

Figure 13:
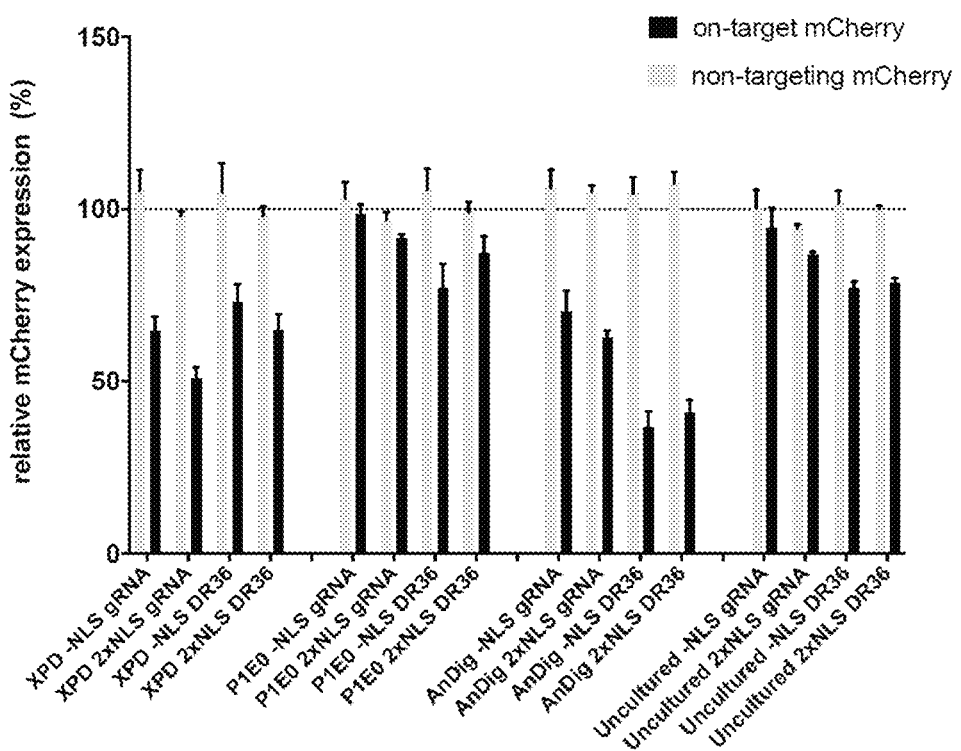
FIG. 13 is a bar graph showing RNA targeting in human cells using the disclosed methods.

RNA can be targeted in human cells using the active Cas13d nuclease. As a proof of concept, human U-2 OS bone osteosarcoma cells were stably integrated with an mCherry reporter and transfected with plasmids encoding human codon optimized Cas13d and guide RNAs targeting the mCherry transcript (FIG. 13).

Cas13d proteins were also fused with N- and C-terminal NLS sequences (SPKKKRKVEAS, SEQ ID NO: 256, for the N-terminal NLS and GPKKKRKVAAA, SEQ ID NO: 258, C-terminal NLS) to understand if nuclear localization can affect mCherry knockdown (these are denoted the 2×NLS constructs). Guide RNAs were either provided in a vector with a U6 promoter operably linked to a 36 nt DR-30 nt spacer-36 nt DR sequence, which mimics the unprocessed CRISPR guide array (denoted DR36), or to a 30 nt DR-22 nt spacer to mimic the processed, mature gRNA (denoted gRNA). The DR36 construct is presumed to be processed by Cas13d into mature gRNAs within the cell. The spacer sequences within the DR36 or gRNA molecules were either complementary to the mCherry target RNA (on-target mCherry) or computationally optimized to avoid complementarity to mCherry or any endogenous human transcript (non-targeting mCherry).

mCherry knockdown was quantified via flow cytometry and normalized to a transfection control. The non-targeting mCherry guides do not affect mCherry protein levels via flow cytometry, presumably because the mCherry transcripts are not targeted. However, the on-target mCherry guides paired with 4 different Cas13d orthologues exhibited significant mCherry knockdown (FIG. 13). "XPD" refers to *Ruminococcus flavefaciens* XPD3002 Cas13d; "P1E0" refers to Gut metagenome P1E0 Cas13d; "AnDig" refers to Anaerobic digester gut metagenome Cas13d; "Uncultured" refers to uncultured *Ruminococcus* sp. Cas13d.

EXAMPLE 9

In Vivo RNA Targeting Using Cas13d

RNA can be targeted in mouse models of cancer. To observe which cells in the mouse are expressing EGFR, a guide RNA is designed that includes one or more spacer regions complementary to mouse EGFR and is combined with Cas13d having a mutated HEPN domain (such as SEQ ID NO: 2 or 4), and a biotin label. The gRNA and Cas13d coding sequence are cloned into a viral vector (such as a lentivirus) which is used to infect the mice by tail vein injection at a titer to insure 100% infection rates. A fluorescent streptavidin label is administered to the mice. Cells expressing EGFR are visualized and detected with the appropriate excitation frequency for the fluorescent label. Alternatively, Cas13d is delivered in its active form in vivo to mediate target knock-down.

EXAMPLE 10

Treatment of Cancer

Human subjects with histologically confirmed stage 1, EGFR+ breast cancer can be treated with the disclosed methods. Each subject is administered a complex comprising an active Cas13d or a Cas13d protein mutated in the HEPN domain (such as SEQ ID NO: 2 or 4), a guide RNA targeting EGFR, and a toxin, after receiving lumpectomy surgery. Treated individuals are monitored for breast cancer recurrence.

EXAMPLE 11

Treatment of HIV Infection

Human subjects with HIV infection can be treated with the disclosed methods. Each subject is administered a construct comprising an active Cas13d or a Cas13d protein mutated in the HEPN domain (such as SEQ ID NO: 2 or 4), a guide RNA targeting HIV Nef protein, and a toxin. Treated individuals are monitored for HIV progression.

EXAMPLE 12

Treatment of Huntington's Disease

Human subjects with Huntington's Disease can be treated with the disclosed methods. Each individual is administered a construct comprising Cas13d, a guide RNA targeting the Huntington mutation. Treated individuals are monitored for disease progression.

EXAMPLE 13

Alternative Splicing Using Cas13d

Figure 14:
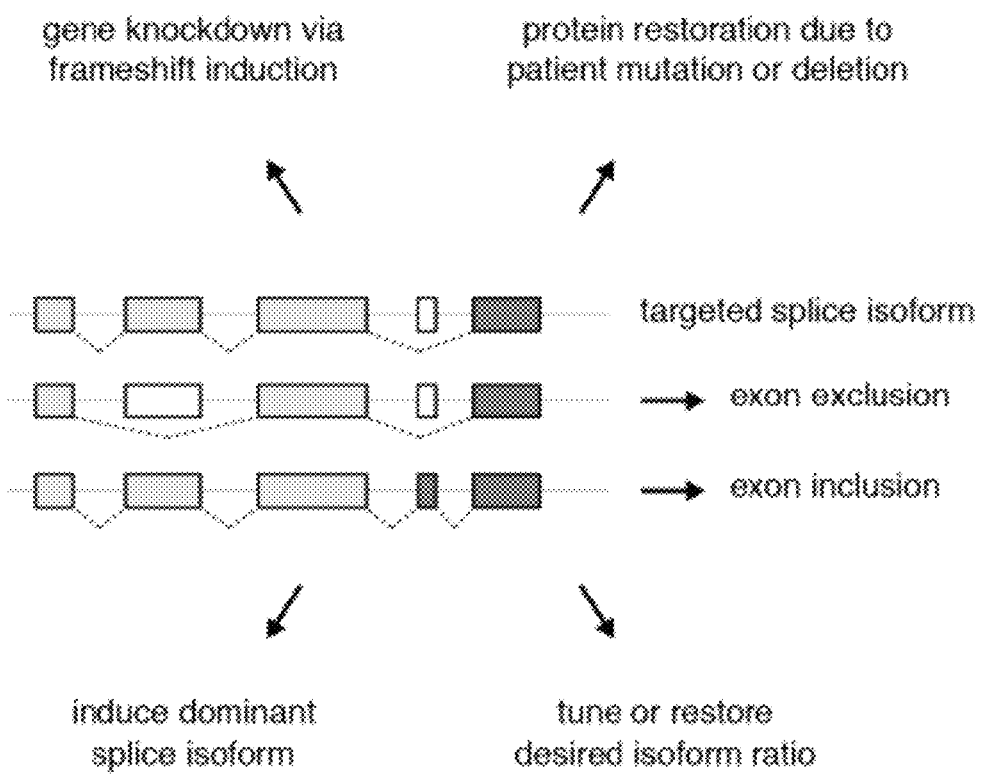
FIG. 14 is a schematic drawing showing how the disclosed Cas13d and DRs can be used to achieve alternative splicing.
Figures 15A, 15B, 15C, 15D:
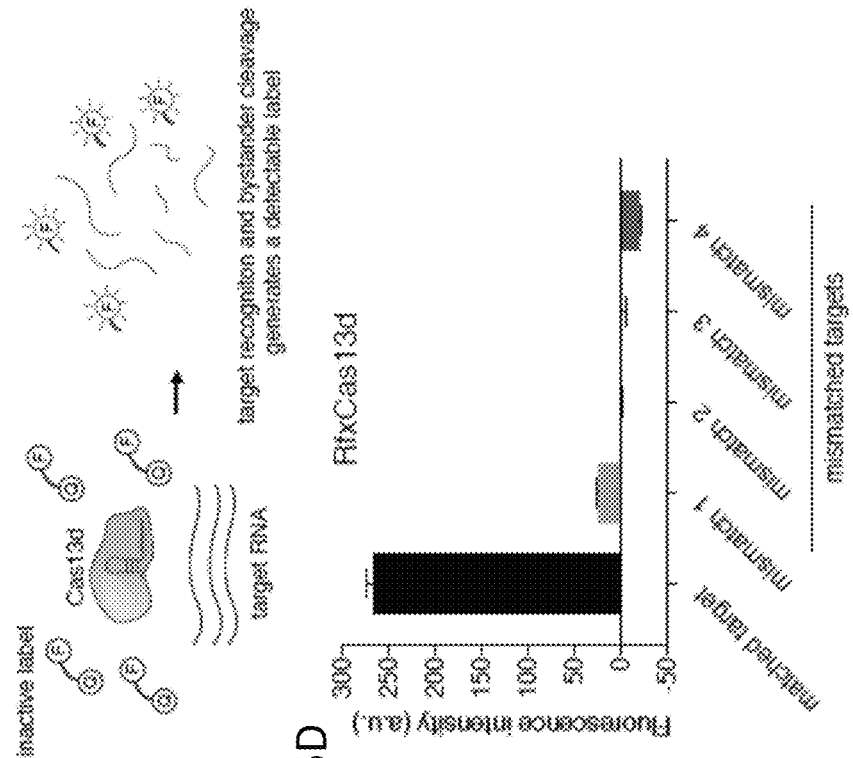
FIGS. 15A-15D are a series of panels showing: (A) Cas13d is converted into an active RNase complex upon binding a target matching the spacer sequence of the guide RNA. It is capable of cleaving gRNA-complementary target RNA or non-complementary bystander RNAs. (B) Cas13d target-dependent RNase activity can be converted into a detectable signal, for example through cleavage of a labeled detector RNA that is cleaved only in the presence of a target matching the spacer of the Cas13d guide RNA. In this example, the detector RNA contains a fluorophore, 'F', and a quencher 'Q', that abolishes fluorescence. Only upon bystander RNA cleavage is the fluorophore liberated from the quencher and fluorescence is generated. (C) Cas13d from *E. siraeum* produces a visible signal only in the presence of a perfectly matched target and not in the presence of different mismatched targets. (D) Cas13d from *R. flavefaciens* strain XPD3002 produces a visible signal only in the presence of a perfectly matched target and not in the presence of different mismatched targets.

Cas13d splice effectors can be used for therapeutic protein restoration (for example that results from a mutation or deletion), gene knockdown via frameshift induction, tuning or restoring a desired isoform ratio, or inducing a desired dominant splice isoform (FIG. 14). Alternative splicing is generally regulated by the interaction of cis-acting elements in the pre-mRNA with positive or negative trans-acting splicing factors, which can mediate exon inclusion or exclusion. dCas13d and Cas13d, with optional fusion to positive or negative splicing factors, can be used as splicing effectors that target to said cis-acting elements in the pre-mRNA to manipulate splicing. Such elements can include exonic splicing enhancers or suppressors, intronic splicing enhancers or suppressors, splice acceptor and splice donor sites, and more generally protein- or RNA-interacting motifs or elements on that particular pre-mRNA, mRNA, or other RNA species, such as a non-coding RNA, tRNA, miRNA, and the like.

Additionally, that the effects of Cas13d-based splice effectors can be guide position-dependent. This can be exploited to perturb or discover particular motifs or sites in an RNA transcript such as protein-binding sites, via steric hindrance, blocking, recruitment, or effector-mediated interaction. For example, the interaction between non-coding RNAs and particular chromatin remodeling complexes can be perturbed. Access of the ribosomal binding site and other elements can be blocked in a 5' or 3' UTR (or to recruit appropriate effector domains) to decrease, increase, or otherwise manipulate translation.

Targeting or tiling Cas13d guides along a pre-mRNA can be used to discover or map new cis-acting elements such as intronic or exonic splice enhancers. This has been exploited in a therapeutic context in the case of the dystrophin gene for optimal antisense oligonucleotide positioning and can also be used for optimal Cas13d positioning. This can be also used to map, mask, or otherwise perturb RNA zipcodes or other cis-acting elements to affect trafficking and localization, chromatin remodeling, polyadenylation, RNA stability and half-life, or levels of nonsense-mediated decay.

In one example, targeting an RNA allows for changing splicing of the target RNA. Both the direct binding of splice acceptor and/or donor sites as well as splice effector domains can be used to manipulate splicing. For example, by using a dCas13d protein with a mutated HEPN domain (e.g., SEQ ID NO: 2 or 4), a guide RNA containing at least one a spacer sequence specific for the target RNA, and optionally an effector domain that affects splicing (such as the RS-rich domain of SRSF1, the Gly-rich domain of hnRNPA1, the alanine-rich motif of RBM4, or the proline-rich motif of DAZAP1), alternative splicing of the RNA can be achieved.

In some examples, such a method is used for exon inclusion, for example to include exon 2 of acid alpha-glucosidase (GAA) to treat Pompe disease or to include exon 7 of SMN2 to treat spinal muscular atrophy (SMA). In some examples, such a method is used for exon exclusion, for example to restore the reading frame of dystrophin to treat Duchenne muscular dystrophy, to shift the splicing of the Bcl-x pre-mRNA from the antiapoptotic long isoform to the proapoptotic short isoform to treat cancer, to shift the splicing of the MAPT transcript to affect ratios of 3R and 4R tau, or to manipulate the splicing of the lamin A transcript in the case of Hutchinson-Gilford progeria syndrome or other genetic diseases of aging.

In some examples, the method uses an Cas13d protein, optionally with a mutated HEPN domain, to mask splice acceptor or donor sites, for example to create neoantigens to make cold tumors hot. By affecting the splicing of certain target pre-mRNAs, this method can generate novel exon-exon junctions that can lead to the creation of neo-epitopes in cancer cells. This can make a cancer cell vulnerable to the immune system due to the display of unnatural antigens. In other examples, this method can be used to dynamically manipulate isoform ratios or to restore reading frame of a protein (e.g., dystrophin for Duchenne's muscular dystrophy).

EXAMPLE 14

AAV Delivery of Cas13d

As described in the examples above, Cas13d can be effectively packaged into AAV to mediate expression in cell types that are not amenable to plasmid delivery or for in vivo delivery of Cas13d. AAV delivery of nuclease active Cas13d can be used to mediate RNA target knock-down in the cell type of interest. Due to its small size compared to other single-effector CRISPR nucleases, Cas13d can be packaged together with a guide RNA or an array containing multiple guide RNAs in a single AAV vector.

EXAMPLE 15

Nucleic Acid-based Diagnostics with Cas13d

Cas13d enzymes can be exploited for nucleic acid-based diagnostics within the context of a cell, using cell-free lysate derived from a cell, or a cell-free system containing an engineered Cas13d enzyme and guide RNA to facilitate formation of a ribonucleoprotein complex. Said guide RNA can be provided in the form of a pre-guide RNA, a mature guide RNA, or an array containing one or more spacer sequences. The components can also be provided in the form of a DNA or RNA precursor encoding for the Cas13d enzyme and appropriate guide RNA design via an in vitro transcription/translation system to facilitate the generation of the necessary components. These components of the diagnostic kit comprise the "sensor" module.

Such a method can be used to determine if a target RNA is present in a test sample. Such a method can also be used to detect a pathogen, such as a virus or bacteria, or diagnose a disease state, such as a cancer (e.g., wherein the target RNA is specific for a particular microbe or disease). Such a method can also be used to test the purity or identity of an environmental sample or agricultural sample, such as seed or soil.

The "sensor" module will then be challenged with a test sample in the form of RNA. Said test sample can be, but is not limited to, a genomic DNA sample that is converted into RNA—for example via in vitro transcription—or a direct RNA sample. These samples can be extracted from biological material such as patient samples (e.g., cells, tissue, blood, plasma, serum, saliva, urine, tumor biopsy, cell free DNA or RNA, exosomes, carrier vesicles or particles) and environmental samples (e.g., soil, water, air, seed, or plant samples). In one embodiment to improve diagnostic sensitivity, nucleic acid molecules in the sample are amplified using amplification techniques, such as polymerase chain reaction, recombinase polymerase amplification, loop mediated isothermal amplification, nucleic acid sequence based amplification, strand displacement amplification, rolling circle amplification, ligase chain reaction, and others (e.g., those that use isothermal amplification). Said amplification techniques can optionally employ nucleic acid conversion techniques such as transcription or reverse transcription with randomized primers or targeted primers.

If the sensor module recognizes a cognate target in the test sample, it will activate an RNase activity. This RNase activity can be detected by using a detectable label. In one example, the detectable label includes an RNA linked to a fluorophore and quencher. The intact detectable RNA links the fluorophore and quencher, suppressing fluorescence. Upon cleavage by Cas13d of the detectable RNA, the fluorophore is released from the quencher and displays detectable fluorescent activity.

In another example, cleavage of the reporter RNA releases a non-fluorescent molecule, which can be converted into a visible signal (e.g., visible by eye). In one example, cleavage of the reporter RNA releases a molecule that can be detected via lateral flow. A molecule that can be detected by lateral flow is any molecule that can be bound specifically by antibodies. In one example, the Cas13d protein along with the guide RNA detecting the target and the reporter RNA conjugated to the reporter molecule can be delivered as a single system in the form of a dry test strip. Upon incubation with the test sample, Cas1Cas13d protein a3d, guide RNA and the reporter RNA are rehydrated and in the presence of the RNA target. The Cas13d protein will cleave the reporter RNA, resulting in the migration of the reporter molecule in the test strip via lateral flow and a resulting positive test line signal by binding to antibodies localized there. Such a shelf stable dry detection system not requiring special (frozen) storage could for example prove advantageous in situations where detection of a target RNA or DNA is performed outside a centralized laboratory facility such as a doctor's office, a hospital, a pharmacy, during field work, in an agricultural setting and so forth.

Cas13d is active over a broad range of temperatures making such an application outside of a controlled laboratory environment feasible.

EXAMPLE 16

Cas13d as a Diagnostic for RNA or DNA Transcribed into RNA In Vitro

Cas13d is capable of converting the presence of a matched target RNA into a visible signal in a minimal diagnostic in vitro system. FIGS. 15A-15D (A) Cas13d is converted into an active RNase complex upon binding a target matching the spacer sequence of the guide RNA. It is capable of cleaving gRNA-complementary target RNA or non-complementary bystander RNAs. (B) Cas13d target-dependent RNase activity can be converted into a detectable signal, for example through cleavage of a labeled detector RNA that is cleaved only in the presence of a target matching the spacer of the Cas13d guide RNA. In this example, the detector RNA contains a fluorophore, 'F', and a quencher 'Q', that abolishes fluorescence. Only upon bystander RNA cleavage is the fluorophore liberated from the quencher and fluorescence is generated. (C) Cas13d from *E. siraeum* produces a visible signal only in the presence of a perfectly matched target and not in the presence of different mismatched targets. (D) Cas13d from *R. flavefaciens* strain XPD3002 produces a visible signal only in the presence of a perfectly matched target and not in the presence of different mismatched targets.

Thus, the system disclosed herein can be part of a lateral flow device (or other solid support), that can be used in diagnostics. The presence of an RNA or DNA sequence can be converted into a signal than can then be detected by conventional lateral flow.

EXAMPLE 17

Cas13d Modifications

Figure 16A:
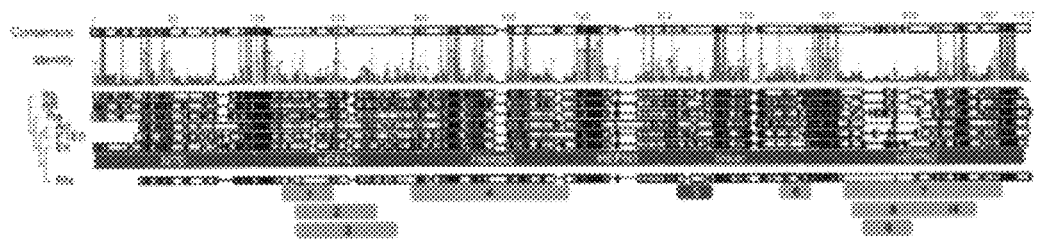
FIGS. 16A-16B: (A) Alignment of 7 orthologs shows regions with high (green bars) and low (red bars) conservation. Regions selected for deletion are marked 1-10. (B) knock-down (top) and splicing (bottom) activity of full-length CasRx and CasRx deletion variants. Deletion variant 5 is shown to retain full activity, demonstrating the feasibility of deleting areas of low conservation while retaining full activity.
Figure 16B:
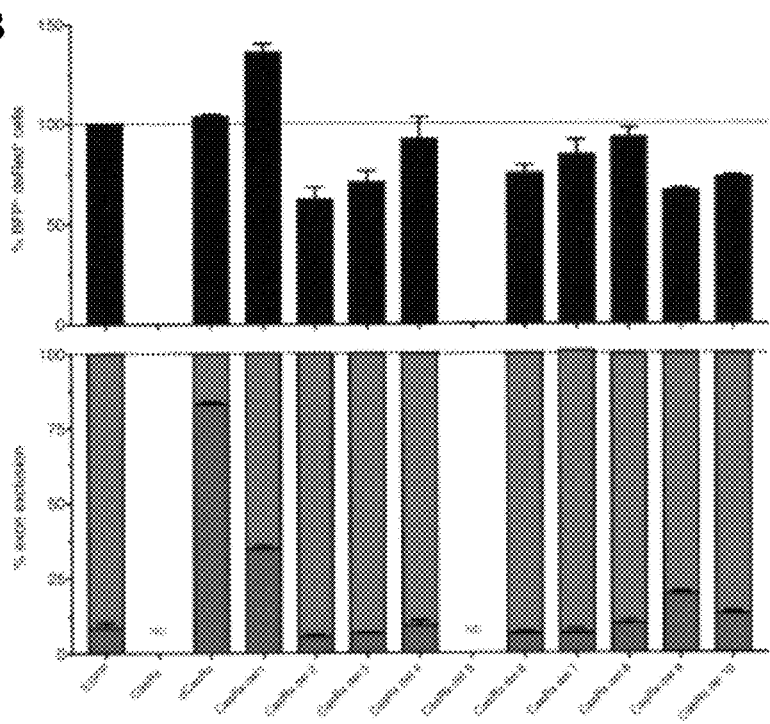

FIGS. 16A-16B, Cas13d is amenable to modifications including truncations of regions with low conservation among orthologs. The alignment of Cas13d orthologs in FIG. 16A shows regions with high (green bars) and low (red bars) conservation.

EXAMPLE 18

Targeting Transcripts In Vivo

Figure 17A:
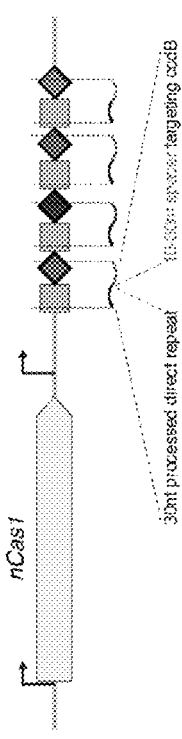
FIGS. 17A and 17B show targeting of ccdB in bacterial cells. (A) construct introduced into bacterial cells expressing ccdB, and (B) relative expression of ccdB under various conditions.

The ccdB gene in bacterial cells was targeted in vivo using different nCas1 orthologues, *Eubacterium siraeum* nCas1 (Es_nCas1; SEQ ID NO: 1); *Eubacterium siraeum* nCas1 with mutated HEPN domains (Es_nCas1 HEPN −/−; SEQ ID NO: 2); uncultured *Ruminococcus* sp. nCas1 (uncul_nCas1; SEQ ID NO: 3) and uncultured *Ruminococcus* sp. nCas1 with mutated HEPN domains (uncul_nCas1 HEPN −/−; SEQ ID NO: 4) (FIG. 17A). Chemically competent *E. coli* (strain BW25141-DE3) cells were transformed with (1) an arabinose-inducible ccdB plasmid, and (2) a second plasmid (targeting vector) carrying a compatible origin of replication, nCas1 protein coding sequence, and nCas1 guide array containing 4 spacer sequences targeting the ccdB transcript (FIG. 17A).

1. artificial Eubacterium siraeum nCas1 array targeting ccdB
a.
(SEQ ID NO: 261)

GAACUACACCCGUGCAAAAAUGCAGGGGUCUAAAACUAACGGC

UCUCUCUUUUAUAGGUGUAAACCGAACUACACCCGUGCAAAAAU

GCAGGGGUCUAAAACCUUUAUCUGACAGCAGACGUGCACUGGCC

AGAACUACACCCGUGCAAAAAUGCAGGGGUCUAAAACCAUCAU

GCGCCAGCUUUCAUCCCCGAUAUGGAACUACACCCGUGCAAAAA

UGCAGGGGUCUAAAACUAAUGGCGUUUUUGAUGUCAUUUCGCG

GUCCGCUGA i. Full 36 nt direct repeat:
(SEQ ID NO: 262)

GAACUACACCCGUGCAAAAAUGCAGGGGUCUAAAAC ii. Spacer 1:

(SEQ ID NO: 263)
UAACGGCUCUCUCUUUUAUAGGUGUAAACC iii. Spacer 2:

(SEQ ID NO: 264)
CUUUAUCUGACAGCAGACGUGCACUGGCCA iv. Spacer 3:

(SEQ ID NO: 265)
CAUCAUGCGCCAGCUUUCAUCCCCGAUAUG v. Spacer 4:

(SEQ ID NO: 266)
UAAUGGCGUUUUUGAUGUCAUUUUCGCGGUCCGCUGA 2. artificial uncultured Ruminoccus sp. nCas1 array targeting ccdB
a.

(SEQ ID NO: 267)
CUACUACACUGGUGCAAAUUUGCACUAGUCUAAAACUAACGGCU

CUCUCUUUUAUAGGUGUAAACCCUACUACACUGGUGCAAAUUUG

CACUAGUCUAAAACCUUUAUCUGACAGCAGACGUGCACUGGCCAC

UACUACACUGGUGCAAAUUUGCACUAGUCUAAAACCAUCAUGCG

CCAGCUUUCAUCCCCGAUAUGCUACUACACUGGUGCAAAUUUGC

ACUAGUCUAAAACUAAUGGCGUUUUUGAUGUCAUUUUCGCGGUC

CGC i. Full 36 nt direct repeat:

(SEQ ID NO: 268)
CUACUACACUGGUGCAAAUUUGCACUAGUCUAAAAC ii. Spacer 1:

(SEQ ID NO: 269)
UAACGGCUCUCUCUUUUAUAGGUGUAAACC iii. Spacer 2:

(SEQ ID NO: 270)
CUUUAUCUGACAGCAGACGUGCACUGGCCA iv. Spacer 3:

(SEQ ID NO: 271)
CAUCAUGCGCCAGCUUUCAUCCCCGAUAUG v. Spacer 4:

(SEQ ID NO: 272)
UAAUGGCGUUUUUGAUGUCAUUUUCGCGGUCCGCUGA

3. Target RNA (ccdB sequence)
a.

(SEQ ID NO: 273)
AUGCAGUUUAAGGUUUACACCUAUAAAAGAGAGAGCCGUUAUCG

UCUGUUUGUGGAUGUACAGAGUGAUAUUAUUGACACGCCCGGGCG

ACGGAUGGUGAUCCCCCUGGCCAGUGCACGUCUGCUGUCAGAUA

AAGUCUCCCGUGAACUUUACCCGGUGGUGCAUAUCGGGGAUGAA

AGCUGGCGCAUGAUGACCACCGAUAUGGCCAGUGUGCCGGUCUC

CGUUAUCGGGGAAGAAGUGGCUGAUCUCAGCCACCGCGAAAAUG

ACAUCAAAAACGCCAUUAACCUGAUGUUUUGGGGAAUA i. spacer 1 target:

(SEQ ID NO: 274)
GGUUUACACCUAUAAAAGAGAGAGCCGUUA ii. spacer 2 target:

(SEQ ID NO: 275)
UGGCCAGUGCACGUCUGCUGUCAGAUAAAG iii. spacer 3 target:

(SEQ ID NO: 276)
CAUAUCGGGGAUGAAAGCUGGCGCAUGAUG iv. spacer 4 target:
(SEQ ID NO: 277)
ACCGCGAAAAUGACAUCAAAAACGCCAUUA v. dCas9 target (underlined):
(SEQ ID NO: 259)
UUAUCGUCUGUUUGUGGAUG The transformed bacteria were plated on 2 mM arabinose plates to induce ccdB expression and harvested after 24 hours. Total RNA was extracted with Trizol followed by random hexamer-mediated reverse transcription and Taqman probe-based qPCR.

Figure 17B:
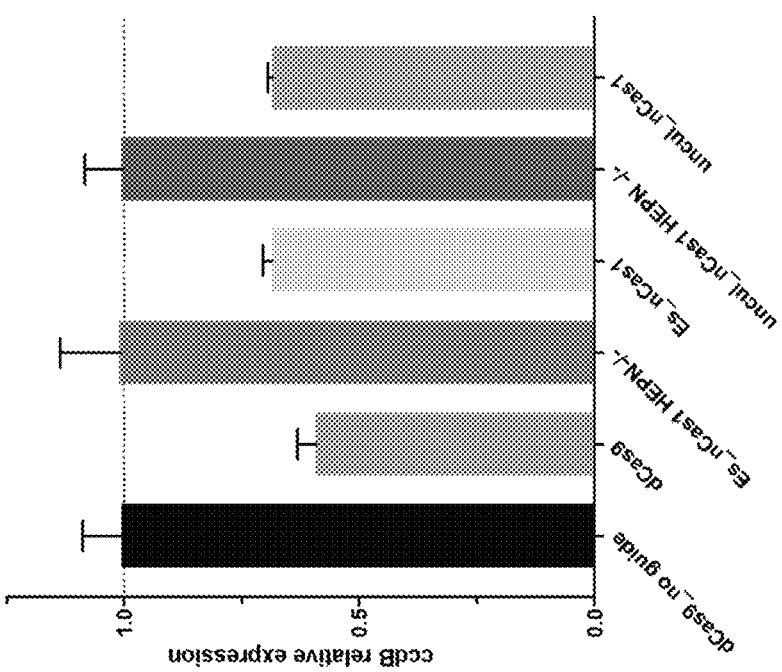

Mutation of the two HEPN domains in each nCas1 protein demonstrate no targeting of ccdB (FIG. 17B, HEPN −/−), while active wild-type nCas1 proteins knock downed the expression of ccdB (FIG. 17B, Es_nCas1; uncul_nCas1). Because dCas9-(catalytically inactive, or "dead" Cas9)-mediated transcriptional repression through binding of the DNA sequence downstream of the transcriptional start site is a current standard in the field, we validate the assay by targeting dCas9 to the ccdB promoter to repress transcription of the ccdB gene. Taken together, this data demonstrates guide RNA-specific degradation of target transcripts in vivo within prokaryotic cells in a HEPN domain-dependent manner.

REFERENCES

Abudayyeh, O. O., Gootenberg, J. S., Essletzbichler, P., Han, S., Joung, J., Belanto, J. J., Verdine, V., Cox, D. B. T., Kellner, M. J., Regev, A., et al. (2017). RNA targeting with CRISPR-Cas13. Nature.

Abudayyeh, O. O., Gootenberg, J. S., Konermann, S., Joung, J., Slaymaker, I. M., Cox, D. B., Shmakov, S., Makarova, K. S., Semenova, E., Minakhin, L., et al. (2016). C2c2 is a single-component programmable RNA-guided RNA-targeting CRISPR effector. Science 353, aaf5573.

Almeida, S., Zhang, Z., Coppola, G., Mao, W., Futai, K., Karydas, A., Geschwind, M. D., Tartaglia, M. C., Gao, F., Gianni, D., et al. (2012). Induced pluripotent stem cell models of progranulin-deficient frontotemporal dementia uncover specific reversible neuronal defects. Cell Rep 2, 789-798.

Anantharaman, V., Makarova, K. S., Burroughs, A. M., Koonin, E. V., and Aravind, L. (2013). Comprehensive analysis of the HEPN superfamily: identification of novel roles in intra-genomic conflicts, defense, pathogenesis and RNA processing. Biol Direct 8, 15.

Batra, R., Nelles, D. A., Pirie, E., Blue, S. M., Marina, R. J., Wang, H., Chaim, I. A., Thomas, J. D., Zhang, N., Nguyen, V., et al. (2017). Elimination of Toxic Microsatellite Repeat Expansion RNA by RNA-Targeting Cas9. Cell 170, 899-912 e810.

Birmingham, A., Anderson, E. M., Reynolds, A., Ilsley-Tyree, D., Leake, D., Fedorov, Y., Baskerville, S., Maksimova, E., Robinson, K., Karpilow, J., et al. (2006). 3' UTR seed matches, but not overall identity, are associated with RNAi off-targets. Nat Methods 3, 199-204.

Biswas, M. H. U., Almeida, S., Lopez-Gonzalez, R., Mao, W., Zhang, Z., Karydas, A., Geschwind, M. D., Biernat, J., Mandelkow, E. M., Futai, K., et al. (2016). MMP-9 and MMP-2 Contribute to Neuronal Cell Death in iPSC Models of Frontotemporal Dementia with MAPT Mutations. Stem Cell Reports 7, 316-324.

Bland, C., Ramsey, T. L., Sabree, F., Lowe, M., Brown, K., Kyrpides, N.C., and Hugenholtz, P. (2007). CRISPR recognition tool (CRT): a tool for automatic detection of clustered regularly interspaced palindromic repeats. BMC Bioinformatics 8, 209.

Boeve, B. F., and Hutton, M. (2008). Refining frontotemporal dementia with parkinsonism linked to chromosome 17: introducing FTDP-17 (MAPT) and FTDP-17 (PGRN). Arch Neurol 65, 460-464.

Cheong, C. G., and Hall, T. M. (2006). Engineering RNA sequence specificity of Pumilio repeats. Proc Natl Acad Sci USA 103, 13635-13639.

Chiriboga, C. A., Swoboda, K. J., Darras, B. T., Iannaccone, S. T., Montes, J., De Vivo, D. C., Norris, D. A., Bennett, C. F., and Bishop, K. M. (2016). Results from a phase 1 study of nusinersen (ISIS-SMN(Rx)) in children with spinal muscular atrophy. Neurology 86, 890-897.

Chylinski, K., Le Rhun, A., and Charpentier, E. (2013). The tracrRNA and Cas9 families of type II CRISPR-Cas immunity systems. RNA Biol 10, 726-737.

Cox, D. B. T., Gootenberg, J. S., Abudayyeh, O. O., Franklin, B., Kellner, M. J., Joung, J., and Zhang, F. (2017). RNA editing with CRISPR-Cas13. Science 358, 1019-1027.

Deltcheva, E., Chylinski, K., Sharma, C. M., Gonzales, K., Chao, Y., Pirzada, Z. A., Eckert, M. R., Vogel, J., and Charpentier, E. (2011). CRISPR RNA maturation by trans-encoded small RNA and host factor RNase III. Nature 471, 602-607.

Dobin, A., Davis, C. A., Schlesinger, F., Drenkow, J., Zaleski, C., Jha, S., Batut, P., Chaisson, M., and Gingeras, T. R. (2013). STAR: ultrafast universal RNA-seq aligner. Bioinformatics 29, 15-21.

Doench, J. G., Petersen, C. P., and Sharp, P. A. (2003). siRNAs can function as miRNAs. Genes Dev 17, 438-442.

Doudna, J. A., and Charpentier, E. (2014). Genome editing. The new frontier of genome engineering with CRISPR-Cas9. Science 346, 1258096.

Du, Y. C., Gu, S., Zhou, J., Wang, T., Cai, H., Macinnes, M. A., Bradbury, E. M., and Chen, X. (2006). The dynamic alterations of H2AX complex during DNA repair detected by a proteomic approach reveal the critical roles of Ca(2+)/calmodulin in the ionizing radiation-induced cell cycle arrest. Mol Cell Proteomics 5, 1033-1044.

East-Seletsky, A., O'Connell, M. R., Burstein, D., Knott, G. J., and Doudna, J. A. (2017). RNA Targeting by Functionally Orthogonal Type VI-A CRISPR-Cas Enzymes. Mol Cell 66, 373-383 e373.

East-Seletsky, A., O'Connell, M. R., Knight, S. C., Burstein, D., Cate, J. H., Tjian, R., and Doudna, J. A. (2016). Two distinct RNase activities of CRISPR-C2c2 enable guide-RNA processing and RNA detection. Nature 538, 270-273.

Edgar, R. C. (2007). PILER-CR: fast and accurate identification of CRISPR repeats. BMC Bioinformatics 8, 18.

Fonfara, I., Richter, H., Bratovic, M., Le Rhun, A., and Charpentier, E. (2016). The CRISPR-associated DNA-cleaving enzyme Cpf1 also processes precursor CRISPR RNA. Nature 532, 517-521.

Gasiunas, G., Barrangou, R., Horvath, P., and Siksnys, V. (2012). Cas9-crRNA ribonucleoprotein complex mediates specific DNA cleavage for adaptive immunity in bacteria. Proc Natl Acad Sci USA 109, E2579-2586.

Gilbert, L. A., Horlbeck, M. A., Adamson, B., Villalta, J. E., Chen, Y., Whitehead, E. H., Guimaraes, C., Panning, B., Ploegh, H. L., Bassik, M. C., et al. (2014). Genome-Scale CRISPR-Mediated Control of Gene Repression and Activation. Cell 159, 647-661.

Gilbert, L. A., Larson, M. H., Morsut, L., Liu, Z., Brar, G. A., Torres, S. E., Stern-Ginossar, N., Brandman, O., Whitehead, E. H., Doudna, J. A., et al. (2013). CRISPR-mediated modular RNA-guided regulation of transcription in eukaryotes. Cell 154, 442-451.

Grissa, I., Vergnaud, G., and Pourcel, C. (2007). CRISPR-Finder: a web tool to identify clustered regularly interspaced short palindromic repeats. Nucleic Acids Res 35, W52-57.

Hammond, S. M., and Wood, M. J. (2011). Genetic therapies for RNA mis-splicing diseases. Trends Genet 27, 196-205.

Heidrich, N., Dugar, G., Vogel, J., and Sharma, C. M. (2015). Investigating CRISPR RNA Biogenesis and Function Using RNA-seq. Methods Mol Biol 1311, 1-21.

Heinz, S., Benner, C., Spann, N., Bertolino, E., Lin, Y. C., Laslo, P., Cheng, J. X., Murre, C., Singh, H., and Glass, C. K. (2010). Simple combinations of lineage-determining transcription factors prime cis-regulatory elements required for macrophage and B cell identities. Mol Cell 38, 576-589.

Hsu, P. D., Lander, E. S., and Zhang, F. (2014). Development and applications of CRISPR-Cas9 for genome engineering. Cell 157, 1262-1278.

Jackson, A. L., Bartz, S. R., Schelter, J., Kobayashi, S. V., Burchard, J., Mao, M., Li, B., Cavet, G., and Linsley, P. S. (2003). Expression profiling reveals off-target gene regulation by RNAi. Nat Biotechnol 21, 635-637.

Jinek, M., Chylinski, K., Fonfara, I., Hauer, M., Doudna, J. A., and Charpentier, E. (2012). A programmable dual-RNA-guided DNA endonuclease in adaptive bacterial immunity. Science 337, 816-821.

Kar, A., Kuo, D., He, R., Zhou, J., and Wu, J. Y. (2005). Tau alternative splicing and frontotemporal dementia. Alzheimer Dis Assoc Disord 19 Suppl 1, S29-36.

Kim, E., Koo, T., Park, S. W., Kim, D., Kim, K., Cho, H. Y., Song, D. W., Lee, K. J., Jung, M. H., Kim, S., et al. (2017). In vivo genome editing with a small Cas9 orthologue derived from *Campylobacter jejuni*. Nat Commun 8, 14500.

Liu, L., Li, X., Wang, J., Wang, M., Chen, P., Yin, M., Li, J., Sheng, G., and Wang, Y. (2017). Two Distant Catalytic Sites Are Responsible for C2c2 RNase Activities. Cell 168, 121-134 e112.

Love, M. I., Huber, W., and Anders, S. (2014). Moderated estimation of fold change and dispersion for RNA-seq data with DESeq2. Genome Biol 15, 550.

Makarova, K. S., Wolf, Y. I., Alkhnbashi, O. S., Costa, F., Shah, S. A., Saunders, S. J., Barrangou, R., Brouns, S. J., Charpentier, E., Haft, D. H., et al. (2015). An updated evolutionary classification of CRISPR-Cas systems. Nat Rev Microbiol 13, 722-736.

Matera, A. G., and Wang, Z. (2014). A day in the life of the spliceosome. Nat Rev Mol Cell Biol 15, 108-121.

Naldini, L. (2015). Gene therapy returns to centre stage. Nature 526, 351-360.

O'Connell, M. R., Oakes, B. L., Sternberg, S. H., East-Seletsky, A., Kaplan, M., and Doudna, J. A. (2014). Programmable RNA recognition and cleavage by CRISPR/Cas9. Nature 516, 263-266.

Orengo, J. P., Bundman, D., and Cooper, T. A. (2006). A bichromatic fluorescent reporter for cell-based screens of alternative splicing. Nucleic Acids Res 34, e148.

Peabody, D. S. (1993). The RNA binding site of bacteriophage MS2 coat protein. EMBO J 12, 595-600.

Ran, F. A., Cong, L., Yan, W. X., Scott, D. A., Gootenberg, J. S., Kriz, A. J., Zetsche, B., Shalem, O., Wu, X., Makarova, K. S., et al. (2015). In vivo genome editing using *Staphylococcus aureus* Cas9. Nature 520, 186-191.

Samai, P., Pyenson, N., Jiang, W., Goldberg, G. W., Hatoum-Aslan, A., and Marraffini, L. A. (2015). Co-transcriptional DNA and RNA Cleavage during Type III CRISPR-Cas Immunity. Cell 161, 1164-1174.

Schena, M., Shalon, D., Davis, R. W., and Brown, P. O. (1995). Quantitative monitoring of gene expression patterns with a complementary DNA microarray. Science 270, 467-470.

Schoch, K. M., DeVos, S. L., Miller, R. L., Chun, S. J., Norrbom, M., Wozniak, D. F., Dawson, H. N., Bennett, C. F., Rigo, F., and Miller, T. M. (2016). Increased 4R-Tau Induces Pathological Changes in a Human-Tau Mouse Model. Neuron 90, 941-947.

Shendure, J., Balasubramanian, S., Church, G. M., Gilbert, W., Rogers, J., Schloss, J. A., and Waterston, R. H. (2017). DNA sequencing at 40: past, present and future. Nature advance online publication.

Shmakov, S., Abudayyeh, O. O., Makarova, K. S., Wolf, Y. I., Gootenberg, J. S., Semenova, E., Minakhin, L., Joung, J., Konermann, S., Severinov, K., et al. (2015). Discovery and Functional Characterization of Diverse Class 2 CRISPR-Cas Systems. Mol Cell 60, 385-397.

Sigoillot, F. D., Lyman, S., Huckins, J. F., Adamson, B., Chung, E., Quattrochi, B., and King, R. W. (2012). A bioinformatics method identifies prominent off-targeted transcripts in RNAi screens. Nat Methods 9, 363-366.

Smargon, A. A., Cox, D. B., Pyzocha, N. K., Zheng, K., Slaymaker, I. M., Gootenberg, J. S., Abudayyeh, O. A., Essletzbichler, P., Shmakov, S., Makarova, K. S., et al. (2017). Cas13b Is a Type VI-B CRISPR-Associated RNA-Guided RNase Differentially Regulated by Accessory Proteins Csx27 and Csx28. Mol Cell 65, 618-630 e617.

Smith, I., Greenside, P. G., Natoli, T., Lahr, D. L., Wadden, D., Tirosh, I., Narayan, R., Root, D. E., Golub, T. R., Subramanian, A., et al. (2017). Evaluation of RNAi and CRISPR technologies by large-scale gene expression profiling in the Connectivity Map. PLoS Biol 15, e2003213.

Swiech, L., Heidenreich, M., Banerjee, A., Habib, N., Li, Y., Trombetta, J., Sur, M., and Zhang, F. (2015). In vivo interrogation of gene function in the mammalian brain using CRISPR-Cas9. Nat Biotechnol 33, 102-106.

Treu, L., Kougias, P. G., Campanaro, S., Bassani, I., and Angelidaki, I. (2016). Deeper insight into the structure of the anaerobic digestion microbial community; the biogas microbiome database is expanded with 157 new genomes. Bioresour Technol 216, 260-266.

van der Oost, J., Westra, E. R., Jackson, R. N., and Wiedenheft, B. (2014). Unravelling the structural and mechanistic basis of CRISPR-Cas systems. Nat Rev Microbiol 12, 479-492.

Wang, Y., Liu, J., Huang, B. O., Xu, Y. M., Li, J., Huang, L. F., Lin, J., Zhang, J., Min, Q. H., Yang, W. M., et al. (2015). Mechanism of alternative splicing and its regulation. Biomed Rep 3, 152-158.

Wright, A. V., and Doudna, J. A. (2016). Protecting genome integrity during CRISPR immune adaptation. Nat Struct Mol Biol 23, 876-883.

Yang, X., Zou, P., Yao, J., Yun, D., Bao, H., Du, R., Long, J., and Chen, X. (2010). Proteomic dissection of cell type-specific H2AX-interacting protein complex associated with hepatocellular carcinoma. J Proteome Res 9, 1402-1415.

Yosef, I., Goren, M. G., and Qimron, U. (2012). Proteins and DNA elements essential for the CRISPR adaptation process in *Escherichia coli*. Nucleic Acids Res 40, 5569-5576.

Zalatan, J. G., Lee, M. E., Almeida, R., Gilbert, L. A., Whitehead, E. H., La Russa, M., Tsai, J. C., Weissman, J. S., Dueber, J. E., Qi, L. S., et al. (2015). Engineering complex synthetic transcriptional programs with CRISPR RNA scaffolds. Cell 160, 339-350.

Zetsche, B., Gootenberg, J. S., Abudayyeh, O. O., Slaymaker, I. M., Makarova, K. S., Essletzbichler, P., Volz, S. E., Joung, J., van der Oost, J., Regev, A., et al. (2015). Cpf1 is a single RNA-guided endonuclease of a class 2 CRISPR-Cas system. Cell 163, 759-771.

Zetsche, B., Strecker, J., Abudayyeh, O. O., Gootenberg, J. S., Scott, D. A., and Zhang, F. (2017). A Survey of Genome Editing Activity for 16 Cpf1 orthologs. bioRxiv.

Zhang, J., Graham, S., Tello, A., Liu, H., and White, M. F. (2016). Multiple nucleic acid cleavage modes in divergent type III CRISPR systems. Nucleic Acids Res 44, 1789-1799.

Zhang, Y., Pak, C., Han, Y., Ahlenius, H., Zhang, Z., Chanda, S., Marro, S., Patzke, C., Acuna, C., Covy, J., et al. (2013). Rapid single-step induction of functional neurons from human pluripotent stem cells. Neuron 78, 785-798.

In view of the many possible embodiments to which the principles of the disclosure may be applied, it should be recognized that the illustrated embodiments are only examples of the invention and should not be taken as limiting the scope of the invention. Rather, the scope of the invention is defined by the following claims. We therefore claim as our invention all that comes within the scope and spirit of these claims.

SEQUENCE LISTING (313 sequences)

SEQ ID NO: 1 - protein, 954 aa, Artificial Sequence
  Eubacterium siraeum nCas1
MGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLRHWCVHSEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFRNTVCHLNAIRNININIKEIKEVENYFALYHYLIQKHLENRFADKKVERDTGDFISKLEEHKTYCKDFVKAYCTPFGYNLVRYKNLTIDGLFDKNYPGKDDSDEQK

SEQ ID NO: 2 - protein, 954 aa, Artificial Sequence
  Eubacterium siraeum nCas1 HEPN-/-
MGKKIHARDLREQRKTDRTEKFADQNKKREAERAVPKKDAAVSVKSVSSVSSKKDNVTKSMAKAAGVKSVFAVGNTVYMTSFGRGNDAVLEQKIVDTSHEPLNIDDPAYQLNVVTMNGYSVTGHRGETVSAVTDNPLRRFNGRKKDEPEQSVPTDMLCLKPTLEKKFFGKEFDDNIHIQLIYNILDIEKILAVYSTNAIYALNNMSADENIENSDFFMKRTTDETFDDFEKKKESTNSREKADFDAFEKFIGNYRLAYFADAFYVNKKNPKGKAKNVLREDKELYSVLTLIGKLAHWCVASEEGRAEFWLYKLDELKDDFKNVLDVVYNRPVEEINNRFIENNKVNIQILGSVYKNTDIAELVRSYYEFLITKKYKNMGFSIKKLRESMLEGKGYADKEYDSVRNKLYQMTDFILYTGYINEDSDRADDLVNTLRSSLKEDDKTTVYCKEADYLWKKYRESIREVADALDGDNIKKLSKSNIEIQEDKLRKCFISYADSVSEFTKLIYLLTRFLSGKEINDLVTTLINKFDNIRSFLEIMDELGLDRTFTAEYSFFEGSTKYLAELVELNSFVKSCSFDINAKRTMYRDALDILGIESDKTEEDIEKMIDNILQIDANGDKKLKKNNGLRNFIASNVIDSNRFKYLVRYGNPKKIRETAKCKPAVRFVLNEIPDAQIERYYEACCPKNTALCSANKRREKLADMIAEIKFENFSDAGNYQKANVTSRTSEAEIKRKNQAIIRLYLTVMYIMLKNLVNVNARYVIAFHCVERDTKLYAESGLEVGNIEKNKTNLTMAVMGVKLENGIIKTEFDKSFAENAANRYLRNARWYKLILDNLKKSERAVVNEFANTVCALNAIRNININIKEIKEVENYFALYHYLIQKHLENRFADKKVERDTGDFISKLEEHKTYCKDFVKAYCTPFGYNLVRYKNLTIDGLFDKNYPGKDDSDEQK

SEQ ID NO: 3 - protein, 919 aa, Artificial Sequence
  Uncultured Ruminococcus sp. nCas1
MAKKNKMKPRELREAQKKARQLKAAEINNNAAPAIAAMPAAEVIAPAAEKKKSSVKAAGMKSILVSENKMYITSFGKGNSAVLEYEVDNNDYNQTQLSSKDNSNIQLGGVNEVNITFSSKHGFESGVEINTSNPTHRSGESSPVRGDMLGLKSELEKRFFGKTFDDNIHIQLIYNILDIEKILAVYVTNIVYALNNMLGVKGSESHDDFIGYLSTNNIYDVFIDPDNSSLSDDKKANVRKSLSKFNALLKTKRLGYFGLEEPKTKDNRVSQAYKKRVYHMLAIVGQIRQCVFHDKSGAKRFDLYSFINNIDPEYRDTLDYLVEERLKSINKDFIEDNKVNISLLIDMMKGYEADDIIRLYYDFIVLKSQKNLGFSIKKLREKMLDEYGFRFKDKQYDSVRSKMYKLMDFLLFCNYYRNDIAAGESLVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISGILKLKEKGKGIHGLRNFITNNVIESSRFVYLIKYANAQKIREVAKNEKVVMFVLGGIPDTQIERYYKSCVEFPDMNSSLGVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYRNCIAHLTVVRELKEYIGDICTVDSYFSIYHYVMQRCITKRENDTKQEEKIKYEDDLLKNHGYTKDFVKALNSPFGYNIPRFKNLSIEQLFDRNEYLTEK

SEQ ID NO: 4 - protein, 919 aa, Artificial Sequence
  Uncultured Ruminococcus sp. nCas1 HEPN-/-
MAKKNKMKPRELREAQKKARQLKAAEINNNAAPAIAAMPAAEVIAPAAEKKKSSVKAAGMKSILVSENKMYITSFGKGNSAVLEYEVDNNDYNQTQLSSKDNSNIQLGGVNEVNITFSSKHGFESGVEINTSNPTHRSGESSPVRGDMLGLKSELEKRFFGKTFDDNIHIQLIYNILDIEKILAVYVTNIVYALNNMLGVKGSESHDDFIGYLSTNNIYDVFIDPDNSSLSDDKKANVRKSLSKFNALLKTKRLGYFGLEEPKTKDNRVSQAYKKRVYHMLAIVGQIAQCVFADKSGAKRFDLYSFINNIDPEYRDTLDYLVEERLKSINKDFIEDNKVNISLLIDMMKGYEADDIIRLYYDFIVLKSQKNLGFSIKKLREKMLDEYGFRFKDKQYDSVRSKMYKLMDFLLFCNYYRNDIAAGESLVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISGILKLKEKGKGIHGLRNFITNNVIESSRFVYLIKYANAQKIREVAKNEKVVMFVLGGIPDTQIERYYKSCVEFPDMNSSLGVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYANCIAALTVVRELKEYIGDICTVDSYFSIYHYVMQRCITKRENDTKQEEKIKYEDDLLKNHGYTKDFVKALNSPFGYNIPRFKNLSIEQLFDRNEYLTEK

SEQ ID NO: 5 - protein, 408 aa, Artificial Sequence
  Gut_metagenome_contig2791000549
MKQNDRENNNKIKKSAAKAVGVKSLARLSDGSTVVSSFGKGAAAELESLITGGEIRKLSDKAILEITDDTQNKNAYNVKSSRIPNLTARTDKLSDKSGMDDLGFKRELELEVFGQCFDDSIHIQIAHAVFDIQKSLAAVIPNVLYTLNNLDRSYSTDNTSDKKDIIGNTLNYQHSYESFNVEKRGEFTEYYNAAKDRFSYFPDILCVLEKVNGKDRYQPKSEKDAFNVLSSVNMLRNSLFHFAPKSNDGKARIAVFKNQFDSDFSHITSTVNKIYSAKIAGVNENFLNNEGNNLYIILKATNWDIKKIVPQLYRFSVLKSDKNMGFNMRKLREFAVESKNIDLSRLNDKFLTNNRKKLYKVIDFIIYYHLNKVLKDSFVDDFVAALRASQSEEEKEKLYAQYSERLFA

SEQ ID NO: 6 - protein, 295 aa, Artificial Sequence
  Gut_metagenome_contig855000317
TDNPLHGAGGIARDHSDLIHARKALEMRYYGQTFEDNIHIQLIYNILDIEKILSVHINNIVYTLNNLLRPLTDNNFDFIGELSTYRDYEKFLEVSEIEYIIDENGEEKQNKEYTKRKLFFRLCYMPQLRYFNIIVEGPHEPVVQVENPELLKKIEASRISDRAKTVTFNEKEFYNVLIALGTLRQMEAHGNPLINIYQFDKKQNVYSTLTKKYKERVITLDNGFLSRAKKNLIILFRAYGIEDAEEKKQYIRNYYDFTVRKNYKNQGFSIKTLREHITTDIEEAIQLRSTAFDSV

SEQ ID NO: 7 - protein, 159 aa, Artificial Sequence
  Gut_metagenome_contig3389000027
PEKAAFTVHNDCEAFFEIDGRVQRAVADNPLHKYEKDDHGQDRISREKLEMRYYGRTFEDNIHIQVIYNILDIEKIMSIHINNIIFTINNLLRREEEDFSDLIGYITLCEKYEDLSKKGREEIRDSFDRLCKAPQLAYYNFQIEKKGKKDPNAIILTEK

SEQ ID NO: 8 - protein, 108 aa, Artificial Sequence
  Gut_metagenome_contig8061000170
EVTGRGQGATADNPLYKYSQKKAWDRQDRISKDKLELRYYGQTFEDNIHIQTIYNILDIEKILSIHINNIVFTINNLLRNDNDEQDDIVGYISLCKKYADLSKEKNAE

SEQ ID NO: 9 - protein, 237 aa, Artificial Sequence
  Gut_metagenome_contig1509000299
MKSTFVLGENNLLMTSFGKGNKAVVEKQIRDQQITDLSDPSAFTVKQDKDLHFNIDGRVRGASTDNPFHHNPEKTAQPPVRDDLIHARSFLEKRYYGENFTDNIHIQCIYSILDVEKILVSHINNIVYMLNNFLREEGETLTDLIGYLSIFKSYEGLMNSTRNDAAEMRRHFFSLCQAKQLGYLNLEVLKPQPDKPKQGKKKPADPNTIKLTEEEFFNVLLALSNMRQMLVHGNAKQ

SEQ ID NO: 10 - protein, 214 aa, Artificial Sequence
  Gut_metagenome_contig9549000591
KAKLEKRYFGQTFEDNIHIQVIYNMLDIEKILTIHVNNIVFTINNFLREEGEDLTDIVGYITKYKSLAKFKENKNAREYYELFCKLCDAKQLGYLNLEYNSVRSKLYKLFDFILVHHYKNDSSPESTALKNLLRTCLTDEEKEKVYVQTAKELTALYSYHFKEASVSVNARNIKEYQEKAQVYHISIADKISSTGIGLFSQLIYMLTLLLDGKE

SEQ ID NO: 11 - protein, 422 aa, Artificial Sequence
  Gut_metagenome_contig71000500
MKKQKSKKTVSKTSGLKEALSVQGTVIMTSFGKGNMANLSYKIPSSQKPQNLNSSAGLKNVEVSGKKIKFQGRHPKIATTDNPLFKPQPGMDLLCLKDKLEMHYFGKTFDDNIHIQLIYQILDIEKILAVHVNNIVFTLDNVLHPQKEELTEDFIGAGGWRINLDYQTLRGQTNKYDRFKNYIKRKELLYFGEAFYHENERRYEEDIFAILTLLSALRQFCFHSDLSSDESDHVNSFWLYQLEDQLSDEFKETLSILWEEVTERIDSEFLKTNTVNLHILCHVFPKESKETIVRAYYEFLIKKSFKNMGFSIKKLREIMLEQSDLKSFKEDKYNSVRAKLYKLFDFIITYYYDHHAFEKEALVSSLRSSLTEENKEEIYIKTARTLASALGADFKKAAADVNAKNIRDYQKKANDYRISFED

SEQ ID NO: 12 - protein, 49 aa, Unknown
  Human gut metagenome
IKIGNTGIGYFSELIYMLTLLLDGKEINDLLTTLINKFDNIISFIDILK

SEQ ID NO: 13 - protein, 148 aa, Artificial Sequence
  Gut_metagenome_contig3915000357
MKDKLEQWYFDKTFDDNIHIQLIYQIQDIEKILASHVNNIVFALDNILHATESETGDFLGMGYMRATNTFEEYRDSAISNVKKSYETFETYIKKKELLYFGEAFYHGNTCRKPEDIYHILAMVSSLRQFCFHSTFDDKSKSIKGSWLY

SEQ ID NO: 14 - protein, 137 aa, Artificial Sequence
  Gut_metagenome_contig4719000173
KNVITSRSFYYLVRYAKPTAVRKLMSNPKIVRYVLKRLPENQVASYYSAIWTQSESNSNETVKLIEMIDRLTTEIAGFSFAVLKDKKDSIVSASRESRAVNLEVERLKKLTTLYMSIAYIAVKSLVKVNARYFIAYS

SEQ ID NO: 15 - protein, 95 aa, Artificial Sequence
  Gut_metagenome_contig6929000468
MKTIKKSSKAYGLKSTFAYNDDVYMTSFGKGNDFVMEKLIYPNDNVEDLSDNPKFDVEVENKDITLKYKKSEINVNNPAKSGIKQDYLMLKDKLE

SEQ ID NO: 16 - protein, 114 aa, Artificial Sequence
  Gut_metagenome_contig7367000486
NRLKTKADLERLFSNRRIGYFGQAFYESDKQQRNEMEIYDNLALIGSLRQWAVHGNKTNDPAWLYKLESLPDEFKSVLDKVYAETVRKVNYKFIKTNAVNLQILQELYPKESFA

SEQ ID NO: 17 - protein, 107 aa, Artificial Sequence
  Gut_metagenome_contig7930000403
YAKIIIGEITSKYNKFDDIINLVYREIRNRNNTINFKNEIKNISTITNYSYFTKFIYFITKFLDGKEINELLTSLINKFDNIQAFNDILLEKLQDKNESKFAIFNGK

SEQ ID NO: 18 - protein, 282 aa, Artificial Sequence
  Gut_metagenome_contig993000527
NIDSLTAVYKGVNNQNRVEFGDKYDMFNKAGEICESLRSINSFARMESPAPAAKRTMFVDAIRMFGFADVSDNDAEKFYKENIEPFIYDRNGDIEDEWKKGKLVHKKDEKKKGVYNFIATNVIESNRFQYLVRYANTEKIAALARNETIVRFVIKKLPAAQIVRYYIACNRIRENINSNVLTSDDMAESLVKLVTGMDFGKIKGVRNDDRSGDKEMKKAIVTLYLTILYHLTKNLVYVNSRYFMAFHCLERDMNLFGEGQKQALRNTGDYPADNADLRRSDI

SEQ ID NO: 19 - protein, 118 aa, Artificial Sequence
  Gut_metagenome_contig6552000639
AVDLNPDDPAFNVNEVTEERFILDHGRIKGCIATADNPLHASSAPQDMLLLKSVLEERFFGMSFPEDNVHIQLIYNILDIEKILTVYSTNAVYAINNLFRADDQEDDEFIGDLSVDTS

SEQ ID NO: 20 - protein, 87 aa, Artificial Sequence
  Gut_metagenome_contig11932000246
RIVNSFAHMKKESMSAKKIMFDEALIVLGIDDAEKERELDQMLDKDARKQNPQRAGLRNFIANNVIESDRFKYLVRYGNVKRIKGIA

SEQ ID NO: 21 - protein, 85 aa, Artificial Sequence
  Gut_metagenome_contig12963000286
EKETELNLMLDKDARKQNRQKAGLRNFIANNVIESERFKYLVRYGNVKRIKGLSTNSQVMGFVLKDIADAQIVRYYRSIYGDDNC

SEQ ID NO: 22 - protein, 155 aa, Artificial Sequence
  Gut_metagenome_contig2952000470
IRLPNGTIMDECDVSKATTVKNRYLHNKKWYSLAFTNYKNSDSDVIVNFRNSVAHLNAIRNIDEYIDGIGEINSHTGYFEIYHYIIQKRMQAVTTDKSKLQPKTEEYFENLSKYHTYCKDFVKAYCVPMAYNLPRYKNLTIDGQFDRNIHTETKE

SEQ ID NO: 23 - protein, 406 aa, Artificial Sequence
  Gut_metagenome_contig451000394
LQELYPKESFASIVKEYYGFLVTKKYKNIGFSIKHLREILLDSTDYRDKEYDSVRHKLYQLLDFCIYHGYLYEDAEFAADLVNQLRASLSELDKEKIYNIEAARLADKLGSSLFSYLRRSVVGKNIQQLKKNAENLEKVKLEDIQISSGKTVSYFTKLMYLLTLFLDGKEINDLLTTLINKFDNIRVFNKTLTQLNQSTEFVEDYSFFGSSGTVFEELTVLNSFARMSRIDPSARKDMYRDAIEILGISMEMSHEKFEEMLDRILCYDEEGNPIINPDGTKKSGMRNFIATNIISSNRFKYLVRYGNATKIRALANCENAVKFVLSTIPDEQIVRYFDSCREPTDHIENNIERKREYLASIIKEMSFERFRDAEKLQRYHVDRPTNGSSVEGEQKQRYQAVIRLYL

SEQ ID NO: 24 - protein, 954 aa, Artificial Sequence; identical to SEQ ID NO: 1
  Eubacterium_siraeum_DSM_15702

SEQ ID NO: 25 - protein, 173 aa, Artificial Sequence
  gut_metagenome_P19E0k2120140920,_c369000003
DGKEINDLVTTLINKTENIASFNEVLKQLGYELDYSEEYSVFAASDEMASQLRALNSFARMEKPDASAKRIMFVEAARMLGDDSSYEELKAYFDDILAKKSKKEFDAATDNEAIRATDKKKKGFRNFIINNVIESDRFKYLIRYCNVESVQAFSKNRKLVKFVLKDIPESQIL

SEQ ID NO: 26 - protein, 111 aa, Artificial Sequence
  Gut_metagenome_contig7593000362
RMSEEAPSAKKVMYVEAAKVLGYSEPEEDLETYIEGILDKKKNVDASGKKNMNFRNFIANNVIESRRFKYLVRYCNPEKIRAMAENRKVVSFVLKGIPDAQIRAYYNSCNG

SEQ ID NO: 27 - protein, 86 aa, Artificial Sequence
  Gut_metagenome_contig12619000055
KLNAGFADKAKTDMQVLLDVLKIKGQEKEIEIAQNYYEFIVKKGYKNEGFSIKKLRQKLTSLSESEKEPLNSMRYDSVRPKLNHLL

SEQ ID NO: 28 - protein, 236 aa, Artificial Sequence
  Gut_metagenome_contig1405000151
KELFQKLCKAPQLAYFNLQIETEGKRKADPNAIKLTQEDFFSILYTLGYMRQMLMHGAPNQNIYKMDPLKDKTFKNCLDCLNRLYNERVMALNNNFLDLAKKNLSILFDVFAVKTQEEKAEYVRDYYDFVVRKQFKNQGFSIKCLREHMTDDIEEAGTLRDQKYDSVRGKLYPFINFAIFRYYNSHSSEAEALVERLRASMNEEEKDKVYRHEAVILWSKIRNLVLKHILPEMEGS

SEQ ID NO: 29 - protein, 103 aa, Artificial Sequence
  Chicken_gut_metagenome_c298474
SDHDKKALVQEYYEFVVLKNYKNLGFSIRRLRDTIIARETGADILSDTEYDTVRSKLYRAMDFKIYLYYQEHPEKAKTLIECLRASTEEAEKEWIYRREASAV

SEQ ID NO: 30 - protein, 225 aa, Artificial Sequence
  Gut_metagenome_contig1516000227
NKFDGESCKSFPLLMYLLCKFLDAKEVNELLTSIINKLENIESLIDALVTLNKWDGFSSNYSLFDKQNIRSLINDFRLVKNLSSSKRKLKKAKQYEYQKNKQLYADAINLFKKDNFVHLNDEEGTGLDLYLSTLLTKKSGNRGDKVKNFIESAIIKNRRFVYLIRYADPEKCYKLVHNEKMLRFVLGEYNEEMMPLSQLQKYYNAVTENNDSNCENRNKMIDTLV

SEQ ID NO: 31 - protein, 210 aa, Artificial Sequence
  Gut_metagenome_contig1838000319
LEYQITPENDVVKLPVSNSSSITVNSANDNIFEVTTSRSDLKDLEAKPSNPTKKSKSSEKSPRQDMLGLKSALEKEYFGKEFNDNIHIQIIHCIQDIEKILAVYSTNANYALVNLLGHNFKDESGKREDFLGSDAFKIEMSYESFSAPANETKLSSEKERTRENEEKRLKYLEDFNNMTDPDNYDKRLGYFGEAFFKPSKNRGKDTVADT

SEQ ID NO: 32 - protein, 84 aa, Artificial Sequence
  Gut_metagenome_contig13123000268
SPKDAGLAYRPAGVRPDQIGAKAALEKRYFGKETPGDNIHVQIAYQIQDIEKLLAVYISNIIYAVNNVTGVSAMKDSKGRPVDL

SEQ ID NO: 33 - protein, 115 aa, Artificial Sequence
  Gut_metagenome_contig5294000434
DKVVHVNVAQGIRDFIEDFKSNSDFSMNSYFELYNYLMQRMLVNEYTKKANDFKVEVPELLITYKNNLDKYKTYDRNFLHIINMPFAYNLARYKNLTIEDIFYDNYKDKLKTKRG

SEQ ID NO: 34 - protein, 377 aa, Artificial Sequence
  Gut_metagenome_contig6415000192
VNSDASDFCKLIYVFTRFLDGKEINILLNSLIKKFQDIHSFNTTVKKLSENNLIINADYVDDYSLFEQSGTVARELMLIKSISKMDFGLDNINLSFMYDDALRTLGVSDENLPEVKREYFGKTKNLSAYIRNNVLENRRFKYVIKYIHPSDVQKIACNKAIAGFVLNRMPDTQIKRYYDSLINKGATDIQAQAKALLDCITGISFDAIKDDKHLHKSKEKSPQRSADRERKKAMLTLYYTIVYIFVKQMLHINSLYTIGFFYLERDQRFIYSRAKKENKNPSKNSYLNDFRSVTAYFIPSEIMKRIEKNENKGFLEDFEALWNSCGKTSRLRKEDVLLYARYISPDHALKNYKMILNSYRNKIAHINVIMSAGKYTG

SEQ ID NO: 35 - protein, 123 aa, Artificial Sequence
  Gut_metagenome_contig6144000300
NKDILKLVIQELPETQILRYYSTIGKNKTTSIDEMKQCLIDAIYNFNIDDTLNAIGDSRVINEKKEQSKAIINLYLTVIYLVTKNMVKINTRFSIAFACLERDYYLHFGQPNGKLLYLQLTEE

SEQ ID NO: 36 - protein, 101 aa, Artificial Sequence
  Gut_metagenome_contig9118000041
DTDCDTQYELFNGDNPGKLANELRICKSLSRMKPEMDEIKKPLYKDALNILNIGNEEFDENTFEFLNREKGDHKLRNFIVNNVIESTRFMYVVKYMNPSNC

SEQ ID NO: 37 - protein, 331 aa, Artificial Sequence
  Activated_sludge_metagenome_transcript_124486
MVKTKAEIHQILRFLGTIRQCLAHKKDAKWDIIFNPDSMSNEFKTLIDSYYNGRVKALNDDFIKHNRSSSLPILFHYYGATEENRRAELTEGFYDFIIKRENKNMGFSLKKIREKMLEKQEASFIKEDGYNSVRHKLYILMDFIIYKTYAADIELQESIVATLRSNLTDEDKEATYEIQAKALWNKIGDDIVKKLMPLIDGNKIKGYKDEKIEIKKEWLKDVMISTENASYMTKMVYFMTLFLDGKEINEFLTVLINKFENIQGFFDVLGHNALAEKIEEPKEISKRPLKGFAELAAFTQKSTDVGLTEHLRLFENSVNISDEIRVTKNFA

SEQ ID NO: 38 - protein, 245 aa, Artificial Sequence
  Gut_metagenome_contig1322000437
INELLTTLINKFDDIQSLMDIATSKQVNVPCKFTSDYSIFNNSSRIVKELNVVKNVARMQKPTASVKTDMLMDALTLLGTDDTMDSEKLRNYVRVQIMKLDAEGKTSKSDDHTLRNFLINNVINSSRFIYVIKYVKADTAYALGHNRKAVAYVLHRIPEQQIDRYYSSCIDRDAGNRMEKENALVDMIVKLSFRDIENVSNDNEKASEKQRYRAVVGLYLTVIYELVKNIVNINSRYVIAFHSLE

SEQ ID NO: 39 - protein, 139 aa, Artificial Sequence
  Gut_metagenome_contig4582000531
SNDHALRNFIVNNVISSSRFTYIIKFINANIAYKIGHNRKAVSYVIKKLPPDQIDRYFTSCIGQESKQAEISDKRQALIDMITTLDYYRFTDINNEDIQKKEQYKAIIGLYLTVVYRLVKNIVNINSRYVIAFHCLERD

SEQ ID NO: 40 - protein, 100 aa, Artificial Sequence
  Gut_metagenome_contig9190000283
FVLNSIPDLQLDRYYKAITGKSDGNRVEKTDIIMDKLMKLDFNQLKVNEDQMGKKNIYFVEKLKALVGLYLTIIYLLTKSLVKINSIYILAFSCFERDYR

SEQ ID NO: 41 - protein, 213 aa, Artificial Sequence
  Gut_metagenome_contig1709000510
PKFKSGSHAQKYYGFIIFKSHKNLGFSIKELRKKLFDIEDAKAFSKKQYDSVRFKMNKLIDFFITYHYTTIDKKQADKLVSKLRYSIDEKEKDDIYTTEAEDLWNKYKSSFEQIRAYVSPDIITEYEHQATNFEYEIKKFDPSTELKTFFSKMIYVLCMFLDGKEINELLSTLINKFDNIDSFITTSEGITDECRFTGTGEKKNIYDIFNASG

SEQ ID NO: 42 - protein, 946 aa, Artificial Sequence
  M24_(LSQX01212483_Anaerobic_digester_metagenome)
MNNKRKTKAKAAGLKSVFFDQKQAVLTTFAKGNNSQIEKKVVNSEVKDLRQPPAFDLELKEKTFYISGKNNINTSRENPLASASLPLSKRQRIRAERIKRAREENRPYHNVKRVGEDDLRAKADLEKHYFGKEYSDNLKIQIIYNILDINKIISPYINDIVYSMNNLARNDEYIDGKIDVIGSLSSTTDYSSFMSPNKDLEKEKKFSFHRENYKKFVEASKPYMRYYGKVFIRDVKKSKLSTGKGEKIEVMYRSDEEIFTIFQILSYVRQSIMHNDIGNKSSILAIEKYPARFVGFLSDLLKTKTNDVNRMFIDNNSQTNFWVLFSIFGLQDHTSGADKICRNFYDFVIKADSKNLGFSLKKIRELMLDLPNANMLRDHQFDTVRSKFYTLLDFIIYQHYLEEKSRIDNMVEKLRMTLKEEEKEVLYAAEAKIVWNAIGAKVINKLVPMMNGDALKEIKRKNRDRKLPQSVIATVQVNSDANVFSGLIYFLTLFLDGKEINEMVSNLITKFENIDSLLHVDREIYKSDEKDLDLEIEKLALFFKGVVRPNAKTDTGAGEISKSFSIFQSAERIIEELKFIKNVTRMDNEIFPSEGVFLDAANVLGVRGDDFDFSNEFVGDDLHSDANKKIINKINGTKEDRNLRNFIINNVVKSRRFQYIARHMNTHYVKQLANNETLNRFVLNKMGDAKIINRYYESISGNTPNIEVRSQIDYLVKRLRSFSFEDLNDVKQKVRPGTNESIEKEKKKALVGLCLTIQYLVYKNLVNINARYTTAFYCLERDSKLKGFGVDVWRDFESYTALTNHFIKEGYLPVRKAEILRANLKHLDCEDGFKYYRNQVTHLNAIRVAYKYINEIKSVHSYFALYHYIMQRHLYDSLQAKAKDSSGFVIDALKKSFEHKIYSKDLLHVLHSPFGYNTARYKNLSIEALFDKNESRPEVNPLSTND

SEQ ID NO: 43 - protein, 150 aa, Artificial Sequence
  Gut_metagenome_contig3833000494
EEASDFKDKKNDSDRRKLYKLMDFCIFYLYYSDSKRNEDLVSRLRESLTDENKDIIYSKEAKTVWNELRKKFSTILDNVKGANIKKLEDVKEKFISEDEFDDIKLDIDISYFSKLMYVMCYFLDGKKINDLLTTLVSKFDNIGSIIEAAK

SEQ ID NO: 44 - protein, 123 aa, Artificial Sequence
  Activated_sludge_metagenome_transcript_117355
MEKMEKIRKSENRKSRAKAAGLKSTFVVADKLALTSFGKGNKANLEKIIKNEEVEEINKPPKFDAKVEEKQIHIIGKTIKDGITEKPAGMRNDLIGAKQELEKMFFGKTFDDNIHIQLIYNIL

SEQ ID NO: 45 - protein, 84 aa, Artificial Sequence
  Gut_metagenome_contig11061000330
SQRDSTINPGEKQISVEKLNPKMVQYAKAVINHGTYCKDAVKALCVPFAYQLVRYKNLTIDGLFDKNHPGDKKEAKTLALDDDV

SEQ ID NO: 46 - protein, 418 aa, Artificial Sequence
  Gut_metagenome_contig338000322
FDNIISFIDILKKLNLEFKFKPEYADFFNMTNCRYTLEELRVINSIARMQKPSADARKIMYRDALRILGMDNRPDEEIDRELERTMPVGADGKFIKGKQGFRNFIASNVIESSRFHYLVRYNNPHKTRTLVKNPNVVKFVLEGIPETQIKRYFDVCKGQEIPPTSDKSAQIDVLARIISSVDYKIFEDVPQSAKINKDDPSRNFSDALKKQRYQAIVSLYLTVMYLITKNLVYVNSRYVIAFHCLERDAFLHGVTLPKMNKKIVYSQLTTHLLTDKNYTTYGHLKNQKGHRKWYVLVKNNLQNSDITAVSSFRNIVAHISVVRNSNEYISGIGELHSYFELYHYLVQSMIAKNNWYDTSHQPKTAEYLNNLKKHHTYCKDFVKAYCIPFGYVVPRYKNLTINELFDRNNPNPEPKEEV

SEQ ID NO: 47 - protein, 418 aa, Unknown; identical to SEQ ID NO: 46
  Human gut metagenome

SEQ ID NO: 48 - protein, 109 aa, Artificial Sequence
  Gut_metagenome_contig9530000097
KSKHYRQCVKEDLLNARKLHTDDYNIDAIRAFRNAVAHLDVVRNMSAYIEGIREINSYYGLYHYLAQRCLQKRCNGALDDNTDYFRTLDKYNTYVKDFVKALCVPFAYN

SEQ ID NO: 49 - protein, 213 aa, Artificial Sequence
  Gut_metagenome_contig1750000258
STPDKARESLRDMLHNISFNDFADVKQDDRRATPEEKVEKERYKAIIGLYLTVMYHLVKNLVYVNSRYVMAFHCLERDAMHYDVCLDNYRDLIRHLISDGDSSCNHFISHNKRMRGCIEEDVNNSEQLIFGKEDAVIRFRNNVAHLSAIRNANEYIDDIREITSYFALYHYLMQRKLIDDCKVNDTAHKYFEKLTKYKTYVMDMVKALCSPFG

SEQ ID NO: 50 - protein, 131 aa, Artificial Sequence
  Gut_metagenome_contig5377000274
KENDILKKSRKKSSVKANGLKSVFVMENKALMTSFGKGNKANPEKELVGGEIRELTDSPVFDASNLGNIIEISRRGVRIEKKGYIASDYEIHKDVINAKDKLEERYFGSAMDDNIHIQMVYQILDIEKILS

SEQ ID NO: 51 - protein, 255 aa, Artificial Sequence
  gut_metagenome_P19E0k2120140920_c248000089
YSADMIDELAGIIHDMKFKQFENVDQSAKRGTPEAADKQQKQNVIRLYLTVCYLFFKNLIYVNSRYFLAFYCLERDVKLWGKTPKFGSREEDTSYTVLTREFMDSGKISTKSKSKNGAESPDEAAKHIPRNYIQKNLDNSDDVAIRYFRNAAEHINALQCAANYLENVEDTESYYRIYHYIMQRYIMQSYSQDKSGGKYDKADARDINDKTKEYFELVENHNTYCKDFVKALCVPFAYNLARFKNLSIDGLFDKN

SEQ ID NO: 52 - protein, 89 aa, Artificial Sequence
  Gut_metagenome_contig11400000031
NIVKHVLKDIPDTQIERYYKSYFNTENAANAEIMREKLASALMQVKYDEFKNVKQKVKNGTEEAFEKERKKALVRLYLTVVYIFVKNLV

SEQ ID NO: 53 - protein, 109 aa, Artificial Sequence
  Gut_metagenome_contig7940000191
NHIDHLNAVRNADKYLNDVRQVTSWYELFHYIVQRALFDDYLKALSYNPDAGKELNPRTLEYFAKVQKYGTCCKDFIKALNVPFAYNLPRYKNLSIDGLFDMNRPGEKG

SEQ ID NO: 54 - protein, 124 aa, Artificial Sequence
  Gut_metagenome_contig6049000251
LYLTSFGKGNAAVIEQKIEPENGYRVTGMQITPSITVNKATDESVRFRVKRKIAQKDEFIADNPMHEGRHRIEPSAGSDMLGLKTKLEKYYFGKEFDDNLHIQIIYNILDIEKILAVYSTNITA

SEQ ID NO: 55 - protein, 233 aa, Artificial Sequence
  Gut_metagenome_contig1137000500
MKKKKNLREQREAKKQERLAACSAKTKAAEIPAAEKPVATTPIAEPVKTDSKKKSSVKAAGLKSTLVLDNKLYTTSFGKGNEAVIEQEVNTADYTVANVNSTPSLEIRSAGDKELSFSSHRQFVNKDELSAVNPLYGGKDKPRKPAGKDMLGLKDKLEERYFGKSFNDNIHIQIIYNILDIEKILAVYATNITVALDHMIDKDVNIEKEDFIGYMNTLNTYEVFMDPSKNPKL

SEQ ID NO: 56 - protein, 69 aa, Artificial Sequence
  Gut_metagenome_contig9368000105
QRHVAEGVEPNRHDFAERFPYYAALYQYHSYVKDFVKALNAPFGYNIPRFKNLTIEELFDRNIHIETYV

SEQ ID NO: 57 - protein, 358 aa, Artificial Sequence
  Gut_metagenome_contig546000275
MDSYRPKLYKLIDFCIFKHYHEYTEISEKNVDTLRAAVSEEQKESFYADEAKRLWGIFDKQFLGFCKKINVWVNGSHEKEILGYIDKDAYRKKSDVSYFSKFLYAMSFFLDGKEINDLLTTLINKFDNIASFISTAKELDAEIDRILEKKLDPVTGKPLKGKNSFRNFIANNVIENKRFIYVIKFCNPKNVLKLVKNTKVTEFVLKRMPESQIDRYYSSCIDTEKNPSVDKKISDLAEMIKKIAFDDFRNVRQKTRTREESLEKERFKAVIGLYLTVVYLLIKNLVNVNSRYVMAFHCLERDAKLYGINIGKNYIELTEDLCRENENSRSAYLARNKRLRDCVKQNIDNAKNMKSKEK

SEQ ID NO: 58 - protein, 114 aa, Artificial Sequence
  Gut_metagenome_contig7216000573
KEMIYANEATFLWDKLGRTFLNFCDNIGAWVKNDHTEEIETYIDKDAYKTSSKVSYFSKLLYAMCFFLDGKEINDLLTTLINKFDNIGSFIETAKELGLSVTFIKDYAFFNASK

SEQ ID NO: 59 - protein, 136 aa, Artificial Sequence
  Gut_metagenome_contig4806000409
LIDSKRLRYFGFEYDPDGKNKNEEMKKRLYHLVAFAGQLRQWSFHSEGNFQLEWLYKLDDSRIAQEYRDTLDYFFDRRFDELNNNFVEQNATNLFILKETFPGEDLKAVTDLYYDFIIVKSQKNIGFSIKKLREKM

SEQ ID NO: 60 - protein, 94 aa, Artificial Sequence
  Gut_metagenome_contig10762000480
CFDTELNPMTEIKIQNLAQKMKDMDFTNFRDVQQKSRDPEKNREKERFKAIIGLYLTVVYRLVKNLADVNARYVMAFHSLERDSSLYNEPVVWK

SEQ ID NO: 61 - protein, 149 aa, Artificial Sequence
  Gut_metagenome_contig4114000374
DTKINPQTWLYQLENTPDLDNEYRDTLDHFFDERFNEINEHFVTQNATNLCIMKEVFPDEDFKSIADLYYDFIVVKSYKNIGFSIKKLREKMLELPEAKRVTSTEMDSVRSKLYKLIDFCIFKHYHEKPETVEMIVSMLRAYTSEDMKE

SEQ ID NO: 62 - protein, 933 aa, Artificial Sequence
  Ruminococcus_flavefaciens_FD1
MKKKMSLREKREAEKQAKKAAYSAASKNTDSKPAEKKAETPKPAEIISDNSRNKTAVKAAGLKSTIISGDKLYMTSFGKGNAAVIEQKIDINDYSFSAMKDTPSLEVDKAESKEISFSSHHPFVKNDKLTTYNPLYGGKDNPEKPVGRDMLGLKDKLEERYFGCTFNDNLHIQIIYNILDIEKILAVHSANITTALDHMVDEDDEKYLNSDYIGYMNTINTYDVFMDPSKNSSLSPKDRKNIDNSRAKFEKLLSTKRLGYFGFDYDANGKDKKKNEEIKKRLYHLTAFAGQLRQWSFHSAGNYPRTWLYKLDSLDKEYLDTLDHYFDKRFNDINDDFVTKNATNLYILKEVFPEANFKDIADLYYDFIVIKSHKNMGFSIKKLREKMLECDGADRIKEQDMDSVRSKLYKLIDFCIFKYYHEFPELSEKNVDILRAAVSDTKKDNLYSDEAARLWSIFKEKFLGFCDKIVVWVTGEHEKDITSVIDKDAYRNRSNVSYFSKLMYAMCFFLDGKEINDLLTTLINKFDNIANQIKTAKELGINTAFVKNYDFFNHSEKYVDELNIVKNIARMKKPSSNAKKAMYHDALTILGIPEDMDEKALDEELDLILEKKTDPVTGKPLKGKNPLRNFIANNVIENSRFIYLIKFCNPENVRKIVNNTKVTEFVLKRIPDAQIERYYKSCTDSEMNPPTEKKITELAGKLKDMNFGNFRNVRQSAKENMEKERFKAVIGLYLTVVYRVVKNLVDVNSRYIMAFHSLERDSQLYNVSVDNDYLALTDTLVKEGDNSRSRYLAGNKRLRDCVKQDIDNAKKWFVSDKYNSITKYRNNVAHLTAVRNCAEFIGDITKIDSYFALYHYLIQRQLAKGLDHERSGFDRNYPQYAPLFKWHTYVKDVVKALNAPFGYNIPRFKNLSIDALFDRNEIKKNDGEKKSDD

SEQ ID NO: 63 - protein, 70 aa, Artificial Sequence
  Gut_metagenome_contig7093000170
RQLAVGLDPKRSGFERNYPYFAKLFEWHTYVKDMVKALNAPFGYNIPRFKNLSIDDLFDMNEERVKDAKA

SEQ ID NO: 64 - protein, 91 aa, Artificial Sequence
  Gut_metagenome_contig11113000384
ASENERKAKQQAGQPAAKGNGEEKQKPILKLNPVRERKLSTTLKSRAKAAGLKSTFVINDKELLMTAFGRGNDAIPEKRILGAQVETLSEK

SEQ ID NO: 65 - protein, 119 aa, Artificial Sequence
  Gut_metagenome_contig6403000259
NKVKEFELDASVKYRLSKVVESVRLKDKATYFTKLIYLTTLFLDGKEINDLLTTLIHQFENIASFIDVMKDRGIADGFSGEYKFFESSKQVAFELRNVNSFARMTKASKDDDNAKQIMF

SEQ ID NO: 66 - protein, 123 aa, Artificial Sequence
  Gut_metagenome_contig6193000124
AEDYYDFLFKKTYKYLGFSIKTLREEFLTIKDAEKLKDKKYDSVRSKLYKVIDFLIFDLYQNRECLRINELVQRLRLSTDELTKAKIYADEAHFVYKKLWDIIDTEIVPQLDQKGIKALEEAY

SEQ ID NO: 67 - protein, 320 aa, Artificial Sequence
  Gut_metagenome_contig721000619
KEGSTMAKNEKKKSTAKALGLKSSFVVNNDIYMTSFGKGNKAVLEKKITENTIENKSDTTYFDVINRDPKGFTLEGRRIADMTAFSNDPKYHVNVVNGKFLEDQLGARSELEKKVFGRTFDDNVHIQLIHNILDIEKIMAQYVSDIVYLLHNTIKRDMNDDIMGYISIRNSFDDFCHPERIPDRKAKDNLQKQHDIFFDEILKCGRLAYFGNAFFEDGSDNKEIAKLKRYKEIYHIIALMGSLRQSYFHGENSDKNFQGPTWAYTLESNLTGKYKEFKDTLDKTFDERYEMISKDFGSTNMVNLQILEELLKMLYGNVSP

SEQ ID NO: 68 - protein, 220 aa, Artificial Sequence
  Gut_metagenome_contig1666000270
KELKFRINGKFIKNYHDRYDEDSANRRWKVVTKQNDVNLFCKLIYMMTLLLDGKEINDLLTTLVNKFDNIASFIDVMEDMGIEHRFIGGYDMFADSKKICVDLQMINSFARMQVTMKSAKKMLYRDALVILGMDQSEEEIERFMLENNIIKDNNEDKSEKKQHDFRNFLINSVINSSRFRYMVRYSSADGLRKLKKSRKLIGFVLNSLPETLIDRYYHSC

SEQ ID NO: 69 - protein, 204 aa, Artificial Sequence
  Gut_metagenome_contig2002000411
EKQNKAKYQAIISLYLMVMYQIVKNMIYVNSRYVIAFHCLERDSNQLLGRFNSRDASMYNKLTQKFITDKYLNDGAQGCSKKVGNYLSHNITCCSDELRKEYRNQVDHFAVVRMIGKYAADIGKFSTWFELYHYVMQRIIFDKRNPLSETERTYKQLIAKHHTYCKDLVKALNTPFGYNLARYKNLSIGELFDRNNYNAKTKET

SEQ ID NO: 70 - protein, 944 aa, Artificial Sequence
  Ruminococcus_albus
MAKKSKGMSLREKRELEKQKRIQKAAVNSVNDTPEKTEEANVVSVNVRTSAENKHSKKSAAKALGLKSGLVIGDELYLTSFGRGNEAKLEKKISGDTVEKLGIGAFEVAERDESTLTLESGRIKDKTARPKDPRHITVDTQGKFKEDMLGIRSVLEKKIFGKTFDDNIHVQLAYNILDVEKIMAQYVSDIVYMLHNTDKTERNDNLMGYMSIRNTYKTFCDTSNLPDDTKQKVENQKREFDKIIKSGRLGYFGEAFMVNSGNSTKLRPEKEIYHIFALMASLRQSYFHGYVKDTDYQGTTWAYTLEDKLKGPSHEFRETIDKIFDEGFSKISKDFGKMNKVNLQILEQMIGELYGSIERQNLTCDYYDFIQLKKHKYLGFSIKRLRETMLETTPAECYKAECYNSERQKLYKLIDFLIYDLYYNRKPARIEEIVDKLRESVNDEEKESIYSVEAKYVYESLSKVLDKSLKNSVSGETIKDLQKRYDDETANRIWDISQHSISGNVNCFCKLIYIMTLMLDGKEINDLLTTLVNKFDNIASFIDVMDELGLEHSFTDNYKMFADSKAICLDLQFINSFARMSKIDDEKSKRQLFRDALVILDIGNKDETWINNYLDSDIFKLDKEGNKLKGARHDFRNFIANNVIKSSRFKYLVKYSSADGMIKLKTNEKLIGFVLDKLPETQIDRYYESCGLDNAVVDKKVRIEKLSGLIRDMKFDDFSGVKTSNKAGDNDKQDKAKYQAIISLYLMVLYQIVKNMIYVNSRYVIAFHCLERDFGMYGKDFGKYYQGCRKLTDHFIEEKYMKEGKLGCNKKVGRYLKNNISCCTDGLINTYRNQVDHFAVVRKIGNYAAYIKSIGSWFELYHYVIQRIVFDEYRFALNNTESNYKNSIIKHHTYCKDMVKALNTPFGYDLPRYKNLSIGDLFDRNNYLNKTKESIDANSSIDSQ

SEQ ID NO: 71 - protein, 449 aa, Artificial Sequence
  Gut_metagenome_contig13552000311
LIDFLIYDLYYNRKPARIEEIVDKLRESVNDEEKESIYSAETKYVYEALGKVLVRSLKKYLNGATIRDLKNRYDAKTANRIWDISEHSKSGHVNCFCKLIYMMTLMLDGKEINDLLTTLVNKFDNIASFIDVMDELGLEHSFTDNYKMFADSKAICLDLQFINSFARMSKIDDEKSKRQLFRDALVVLDIGDKNEDWIEKYLTSDIFKRDENGNKIDGEKRDFRNFIANNVIKSARFKYLVKYSSADGMIKLKKNEKLISFVLEQLPETQIDRYYESCGLDCAVADRKVRIEKLTGLIRDMRFDNFRGVNYSNDACKKDKQAKAKYQAIISLYLMVLYQIVKNMIYVNSRYVIAFHCLERDLLFFNIELDNSYQYSNCNELTEKFIKDKYMKEGALGFNMKAGRYLTKNIGNCSNELRKIYRNQVDHFAVVRKIGNYAADIASVGSWFE

SEQ ID NO: 72 - protein, 96 aa, Artificial Sequence
  Gut_metagenome_contig10037000527
YMDQNFANSDAWAIHVYRNKIQHLDAVRHADMYIGDIREFHSWFELYHYIIQRRIIDQYAYESTPGSSRDGSAIIDEERLNPATRRYFRLITTYKT

SEQ ID NO: 73 - protein, 519 aa, Artificial Sequence
  Gut_metagenome_contig238000329
RYDKDRSKIYTMMDFVIYRYYIDNNNDSIDFINKLRSSIDEKSKEKLYNEEANRLWNKLKEYMLYIKEFNGKLASRTPDRDGNISEFVESLPKIHRLLPRGQKISNFSKLMYLLTMFLDGKEINDLLTTLINKFENIQGFLDIMPEINVNAKFEPEYVFFNKSHEIAGELKLIKGFAQMGEPAATLKLEMTADAIKILGTEKEDAELIKLAESLFKDENGKLLGNKQHGMRNFIGNNVIKSKRFHYLIRYGDPAHLHKIATNKNVVRFVLGRIADMQKKQGQKGKNQIDRYYEVCVGNKDIKKTIEEKIDALTDIIVNMNYDQFEKKKAVIENQNRGKTFEEKNKYKRDNAEREKFKKIISLYLTVIYHILKNIVNVNSRYILGFHCLERDKQLYIEKYNKDKLDGFVALTKFCLGDEERYEDLKAKAQASIQALETANPKLYAKYMNYSDEEKKEEFKKQLNRERVKNARNAYLKNIKNYIMIRLQLRDQTDSSGYLCGEFRDKVAHLEVARHAHEYI

SEQ ID NO: 74 - protein, 181 aa, Artificial Sequence
  Gut_metagenome_contig2643000492
NGEIVSLAEKEAFSAKIADKNIGCKIENKQFRHPKGYDVIADNPIYKGSPRQDMLGLKETLEKRYFSPSDSIDNVRVQVAHNILDIEKILAEYITNAVYSFDNIAGFGKDIIGDDFSPVYTYDKFEKSDRYEYFKNLLNNSRLGYYGQAFFECDDSKENKKKKDAIKCYNIIALLSGLRHW

SEQ ID NO: 75 - protein, 440 aa, Artificial Sequence
  Gut_metagenome_contig874000057
MSKNKESYAKGMGLKSALVSGSKVYMTSFEGGNDAKLEKVVENSEIVSLAEKESFSAEIFKKNIGCKIENKKFKHPKRYDVIADNPLYKGSVRQDMLGLKETLEKRYFNSADGTDNVCIQVIHNILDIEKILAEYITNAVYSFDNIAGFGEDIIGMGGFKPIYTYKQFKEPDKYNKKFDDILNNSRLGYYGKAFFEKNDLKHNPNKKKRDKNPYILKYDNECYYIIALLSGLRHWNIHSHAKDDLVSYRWLYNLDSILNREYISTLNYLYDDIADELTESFSKNSSANVNYIAETLNIDPSEFAQQYFRFSIMKEQKNMGFNVSKLREIMLDRKELSDIRDNHRVFDSIRSKLYTMMDFVIYRYYIEEAAKTEAENRNLPENEKKISEKDFFVINLRGSFDENQKEKLYIEEAKRLWEKLKDIMLKIKEFRGEKVKEYKK

SEQ ID NO: 76 - protein, 137 aa, Artificial Sequence
  Gut_metagenome_contig4781000489
LDKQLDYEYIRTLNYMFNDIADELTRTFSKNSAANVNYIAETLNIDPNKFAEQYFRFSIMKEQKNLGFNLTKLRESMLDRRELSDIRDNHNVFDSIRPKLYTMMDFVIYKHYIDEAKKTEAENKSLPDDRKNLSEKD

SEQ ID NO: 77 - protein, 87 aa, Artificial Sequence
  Gut_metagenome_contig12144000352
RMGEPVANTKRVMMIDAVKILGTDLSDDELKEMADSFFKDSDGNLLKKGKHGMRNFITNNVIKNKRFHYLIRYGDPAHLHEIAKNEA

SEQ ID NO: 78 - protein, 414 aa, Artificial Sequence
  Gut_metagenome_contig5590000448
VHNNEEKDLIKYTWLYNLDKYLDAEYITTLNYMYNDIGDELTDSFSKNSAANINYIAETLGIDPKTFAEQYFRFSIMKEQKNLGFNLTKLREVMLDRKDMSEIRENHNDFDSIRAKVYTMMDFVIYRYYIEEAAKVNAANKSLPDNEKSLSEKDIFVISLRGSFNEDQKDRLYYDEAQRLWSKVGKLMLKIKKFRGKDTRKYKNMGTPRIRRLIPEGRDISTFSKLMYALTMFLDGKEINDLLTTLINKFDNIQSFLKVMPLIGVNAKFAEEYSFFNNSEKIADELRLIKSFARMGEPVADARRAMYIDAIRILGTDLSDDELKALADSFSLDENGNKLGKGKHGMRNFIINNVITNKRFHYLIRYGNPVHLHEIAKNEAVVKFVLGRIADIQKKQGQNGKNQIDRYYETCIGK

SEQ ID NO: 79 - protein, 109 aa, Artificial Sequence
  Gut_metagenome_contig9269000031
LSEKDIFVISLRGSFNEDQKDRLYYDEAQRLWSKLGKLMLKIKEFKGKDTKKYRDMGKPRLRRILPEGRDISTFSKLMYALTMFLDGKEINDLLTTLINKFDNIQSFLK

SEQ ID NO: 80 - protein, 105 aa, Artificial Sequence
  Gut_metagenome_contig8537000520
SARLADELRIVKSVSRMEMPMPAAKTLMFEDALKLFWIDSPEEAKKIISGDNKKIRNFIANNVVESSWFNYIVRYTDLKNARDFIRCRPIVEFVLNKVPETQIDR

SEQ ID NO: 81 - protein, 211 aa, Artificial Sequence
  Gut_metagenome_contig1845000130
SSLNEVEKDAIYAEEAKQAWVNIRDLVIRHILPMMKGDYIAQISVEDEKIDQSILEDVFISKITPSALAEFIYIVTLFIDGKEINDLLTQMIHKFDSIAAFQEVMRQRCMVTQFNQDYAIFEQSGKIAEDLRVVNSFARMSISKDGPNVKGAMFREALLILGLASPDETMESVLQKYMNSNLDRERKSVRNFVINNVIQSRRFHYLVRYGN

SEQ ID NO: 82 - protein, 906 aa, Artificial Sequence
  gut_metagenome_P13E0k2120140920_c3000072
MEREVKKPPKKSLAKAAGLKSTFVISPQEKELAMTAFGRGNDALLQKRIVDGVVRDVAGEKQQFQVQRQDESRFRLQNSRLADRTVTADDPLHRAETPRRQPLGAGMDQLRRKAILEQKYFGRTFDDNIHIQLIYNILDIHKMLAVPANHIVHTLNLLGGYGETDFVGMLPAGLPYDKLRVVKKKNGDTVDIKADIAAYAKRPQLAYLGAAFYDVTPGKSKRDAARGRVKREQDVYTILSLMSLLRQFCAHDSVRIWGQNTPAALYGLQALPQDMKDLLDDGWRRALGGVNDHFLDTNKVNLLTLFEYYGAETKQERVALTQDFYRFVVLKEQKNMGFSLRRLREELLKLPDAAYLTGQEYDSVRQKLYMLLDFLLCRLYAQERADRCEELVSALRCALSDEEKDAVYQAEAAALWQALGDTLRRELLPLLKGKKLQDKDKKKLDELGLSRDVLDGVLFRPAQQGSRANADYFCRLMHLSTWFMDGKEINTLLTTLISKLENIDSLRSVLESMGLAYSFVPAYAMFDHSRYIAGQLRVVNNIARMRKPAIGAKREMYRAAVVLLGVDSPEAAAAITDDLLQIDPETGKVRPRGDSARDTGLRNFVANNVVESRRFTYLLRYMTPEQARVLAQNEKLIAFVLSTVPSAQLERYCRTCGREDITGRPAQIRYLTAQIMGVRYESFTDVEQRGRGDNPKKERYKALIGLYLTVLYLAVKNMVNCNARYVIAFYCRDRDTALYQKEVCWYDLEEDKKSGKQRQVEDYTALTRYFVSQGYLNRHACGYLRSNMNGISNGLLAAYRNAVDHLNVIPPLGSLCRDIGRVDSYFALYHYAVQQYLNGRYYRKTPREQELFAAMAQHRTWCSDLVKALNTPFGYNLARYKNLSIDGLFDREGDHVVREDGEKPAE

SEQ ID NO: 83 - protein, 906 aa, Artificial Sequence
  gut_metagenome_P1E0k2120140920_c1000078
MEREVKKPPKKSLAKAAGLKSTFVISPQEKELAMTAFGRGNDALLQKRIVDGVVRDVAGEKQQFQVQRQDESRFRLQNSRLADRTVTADDPLHRAETPRRQPLGAGMDQLRRKAILEQKYFGRTFDDNIHIQLIYNILDIHKMLAVPANHIVHTLNLLGGYGETDFVGMLPAGLPYDKLRVVKKKNGDTVDIKADIAAYAKRPQLAYLGAAFYDVTPGKSKRDAARGRVKREQDVYAILSLMSLLRQFCAHDSVRIWGQNTTAALYHLQALPQDMKDLLDDGWRRALGGVNDHFLDTNKVNLLTLFEYYGAETKQARVALTQDFYRFVVLKEQKNMGFSLRRLREELLKLPDAAYLTGQEYDSVRQKLYMLLDFLLCRLYAQERADRCEELVSALRCALSDEEKDTVYQAEAAALWQALGDTLRRKLLPLLKGKKLQDKDKKKSDELGLSRDVLDGVLFRPAQQGSRANADYFCRLMHLSTWFMDGKEINTLLTTLISKLENIDSLRSVLESMGLAYSFVPAYAMFDHSRYIAGQLRVVNNIARMRKPAIGAKREMYRAAVVLLGVDSPEAAAAITDDLLQIDPETGKVRPRSDSARDTGLRNFIANNVVESRRFTYLLRYMTPEQARVLAQNEKLIAFVLSTVPDTQLERYCRTCGREDITGRPAQIRYLTAQIMGVRYESFTDVEQRGRGDNPKKERYKALIGLYLTVLYLAVKNMVNCNARYVIAFYCRDRDTALYQKEVCWYDLEEDKKSGKQRQVEDYTALTRYFVSQGYLNRHACGYLRSNMNGISNSLLTAYRNAVDHLNAIPPLGSLCRDIGRVDSYFALYHYAVQQYLNGRYYRKTPREQELFAAMAQHRTWCSDLVKALNTPFGYNLARYKNLSIDGLFDREGDHVVREDGEKPAE

SEQ ID NO: 84 - protein, 84 aa, Artificial Sequence
  Gut_metagenome_contig12990000099
INDLLTTLIHKFENIAAFLHVIQAEKLPVEFVPEFQVFSDSQKIAEELRIINSFARMNKPSANAREIMYIEAFKVLGMSGDEKQ

SEQ ID NO: 85 - protein, 345 aa, Artificial Sequence
  Gut_metagenome_contig525000349
MSKKENRKSYVKGLGLKSTLVSDSKVYLTTFADGSNAKLEKCVENNKIICISNDKEAFAASIANKNVGYKIKNDEKFRHPKGYDIISNNPLLHNNSVQQDMLGLKNVLEKRYFGKSSGGDNNLCIQIIHNIIDIEKILSEYIPNVVYAFNNIAGFKDEHNNIIDIIGTQTYNSSYTYADFSKDKSDKKYIEFQKLLKNKRLGYWGKAFFTGQGNNAKVRQENQCFHIIALLISLRNWATHSNELDKHTKRTWLYKLDDTNILNAEYVKTLNYLYDTIADELTKSFSKNGAVNVNYLAKKYNIKDDLPGFSEQYFRFSIMKEQKNLGFNISKLRENMLDFKDMSVI

SEQ ID NO: 86 - protein, 206 aa, Artificial Sequence
  Gut_metagenome_contig7229000302
KKISSLTKFCLGESDEKKLKALAKKSLEELKTTNSKLYENYIKYSDERKAEEAKRQINRERAKTAMNAHLRNTKWNDIMYGQLKDLADSKSRICSEFRNKAAHLEVARYAHMYINDISEVKSYFRLYHYIMQRRIIDVIENNPKAKYEGKVKVYFEDVKKNKKYNKNLLKLMCVPFGYCIPRFKNLSIEQMFDMNETDNSDKKKEK

SEQ ID NO: 87 - protein, 95 aa, Artificial Sequence
  Gut_metagenome_contig3227000343
IGDISEVNSYFQLYHYIMQRILIDKIGSKTTGKAKEYFDSVIVNKKYDDRLLKLLCSPLGYCLTRYKDLSIEALFDMNEAAKYDKLNKERKNKKK

SEQ ID NO: 88 - protein, 115 aa, Artificial Sequence
  Gut_metagenome_contig7030000469
SIRSKLYTMMDFVIYRYYIEESAKAAAENKPSESDSFVIRLRGSFNENQKEELYIEEAERLWKKFGEIMLKIKEFRGEKVKEYKKEVPRIERILPHGKDISAFSKLMYMLSMFLD

SEQ ID NO: 89 - protein, 110 aa, Artificial Sequence
  Gut_metagenome_contig5149000068
FRNKVAHLEAVRYAHLYINDIAEVNSYFQLYHYIIQRRIMAECYDKSSGKVREYFNAVNKEKKYNDRLLKLLCVPFGYCVTRFKDLSIEALFDKNEADRFDKEKKKAEKK

SEQ ID NO: 90 - protein, 84 aa, Artificial Sequence
  Gut_metagenome_contig400200045
MIEKKKSYAKGMGLKSTIVSGSKVYMTTFGDGSEARLEKVVENDSIKTLHEGEAFSAEMTDNNAGYKIGNVKFSHPNGYDVVAN

SEQ ID NO: 91 - protein, 94 aa, Artificial Sequence
  Gut_metagenome_contig10420000446
SSKSVAEKVNALTKIITGMNYDQFDSRRNVIENTGAGNAEREKYKKIISLYLTVIYHILKNIVNINSRYVIGFHCVERDAQLYKEKGYDINLKK

SEQ ID NO: 92 - protein, 967 aa, Artificial Sequence
  new_flavefaciens,_strain_XPD3002
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 93 - protein, 146 aa, Artificial Sequence
  M26_Gut_metagenome_contig698000307
MIEKKKSFAKGMGVKSTLVSGSKVYMTTFAEGSDAKLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYSVTD

SEQ ID NO: 94 - protein, 724 aa, Artificial Sequence
  M36_Uncultured_Eubacterium_sp_TS28_c40956
RIRFVLSGIFVNAFSSKHGFESGVEINTSNPTHRSGESSPVRGDMLGLKSELEKRFFGKTFDDNIHIQLIYNILDIEKILAVYVTNIVYALNNMLGVKGSESHDDFIGYLSTNNTYDVFIDPDNSSLSDDKKANVRKSLSKFNVLLKTKRLGYFGLEEPKTKDNRVSEAYKKRVYHMLAIVGQIRQCVFHDKSGAKRFDLYSFINNIDPEYRDTLDYLVEERLKSINKDFIQGNKVNISLLIDMMKGYEADDIIRLYYDFIVLKSQKNLGFSIKKLREKMLEEYGFRFKDKQYDSVRSKMYKLMDFLLFCNYYRNDIAAGEALVRKLRFSMTDDEKEGLYADEAAKLWGKFRNDFENIADHMNGDVIKELGKADMDFDEKILDSEKKNASDLLYFSKMIYMLTYFLDGKEINDLLTTLISKFDNIKEFLKIMKSSAVNVECELTAGYKLFNDSQRITNELFIVKNIASMRKPAASAKLTMFRDALTILGIDDKITDDRISEILKLKEKGKGIHGLRNFITNNVIESSRFVYLIKYANAQKIRKVAENEKVVMFVLGGIPDTQIERYYKSCVEFPDMNSSLEVKRSELARMIKNISFDDFKNVKQQAKGQRKRRLRRGQKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYRNCIAHL

SEQ ID NO: 95 - protein, 219 aa, Artificial Sequence
  M12_gut_metagenome_P25C0k2120140920_c134000066
MAKKNKMKPRELREAQKKARQFKAAEINNNAAPAIAAMPAAEVIAPVAEKKKSSVKAAGMKSILVSENKMYITSFGKGNSAVLEYEVDNNDYNKTQLSSKDNSNIELCGVNEVNITFSSKHGFESGVEINTSNPTHRSGESSPVRWDMLGLKSELEKRFFGKTFDDNIHIQLIYNILDIEKILAVYVTNIVYALNNMLGVKGSESHDDFIGYLSTNNIY

SEQ ID NO: 96 - protein, 915 aa, Unknown
  Human gut metagenome
MAKKNKMKPRELREAQKKARQFKAAEINNNAAPAIAAMPAAEVIAPVAEKKKSSVKAAGMKSILVSENKMYITSFGKGNSAVLEYEVDNNDYNKTQLSSKDNSNIELCGVNEVNITFSSKHGFESGVEINTSNPTHRSGESSPVRWDMLGLKSELEKRFFGKTFDDNIHIQLIYNILDIEKILAVYVTNIVYALNNMLGVKGSESHDDFIGYLSTNNIYDVFIDPDNSSLSDDKKANVRKSLSKFNVLLKTKRLGYFGLEEPKTKDTRVSQAYKKRVYHMLAIVGQIRQCVFHDKSGAKRFDLYSFINNIDPEYRETLDYLVDERFDSINKGFIQGNKVNISLLIDMMKGYEADDIIRLYYDFIVLKSQKNLGFSIKKLREKMLEEYGYRFKDKQMYKLMDFLLFCNYYRNDVVAGEALVRKLRFSMTDDEKEGIYADEASKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPASSAKLTMFRDALTILGIDDNITDDRISEILKLKEKGKGIHGLRNFITNNVIESSRFVYLIKYANAQKIREVAKNEKVVMFVLGGIPDTQIERYYKSCVEFPDMNSSLEVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDNGDESPNLFLKKNKRLRKCVEVDINNADSNMTRKYRNCIAHLTVVRELKEYIGDIRTVDSYFSIYHYVMQRCITKREDDTKQEEKIKYEDDLLKNHGYTKDFVKALNSPFGYNIPRFKNLSIEQLFDRNEYLTEK

SEQ ID NO: 97 - protein, 922 aa, Artificial Sequence
  M10_gut_metagenome_P25C90k2120140920,_c28000041
MAKKNKMKPRELREAQKKARQFKAAEINNNAAPAIAAMPAAEVIAPVAEKKKSSVKAAGMKSILVSENKMYITSFGKGNSAVLEYEVDNNDYNKTQLSSKDNSNIELCGVNEVNITFSSKHGFESGVEINTSNPTHRSGESSPVRWDMLGLKSELEKRFFGKTFDDNIHIQLIYNILDIEKILAVYVTNIVYALNNMLGVKGSESHDDFIGYLSTNNIYDVFIDPDNSSLSDDKKANVRKSLSKFNVLLKTKRLGYFGLEEPKTKDTRVSQAYKKRVYHMLAIVGQIRQCVFHDKSGAKRFDLYSFINNIDPEYRETLDYLVDERFDSINKGFIQGNKVNISLLIDMMKGYEADDIIRLYYDFIVLKSQKNLGFSIKKLREKMLEEYGYRFKDKQYDSVRSKMYKLMDFLLFCNYYRNDVVAGEALVRKLRFSMTDDEKEGIYADEASKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPASSAKLTMFRDALTILGIDDNITDDRISEILKLKEKGKGIHGLRNFITNNVIESSRFVYLIKYANAQKIREVAKNEKVVMFVLGGIPDTQIERYYKSCVEFPDMNSSLEVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDNGDESPNLFLKKNKRLRKCVEVDINNADSNMTRKYRNCIAHLTVVRELKEYIGDIRTVDSYFSIYHYVMQRCITKREDDTKQEEKIKYEDDLLKNHGYTKDFVKALNSPFGYNIPRFKNLSIEQLFDRNEYLTEK

SEQ ID NO: 98 - protein, 922 aa, Artificial Sequence; identical to SEQ ID NO: 97
  M11_gut_metagenome_P25C7k2120140920_c4078000105

SEQ ID NO: 99 - protein, 636 aa, Artificial Sequence
  gut_metagenome_P25C0k2120140920_c32000045
IRQCVFHDKSGAKRFDLYSFINNIDPEYRETLDYLVDERFDSINKGFIQGNKVNISLLIDMMKGYEADDIIRLYYDFIVLKSQKNLGFSIKKLREKMLEEYGYRFKDKQYDSVRSKMYKLMDFLLFCNYYRNDVVAGEALVRKLRFSMTDDEKEGIYADEASKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPASSAKLTMFRDALTILGIDDNITDDRISEILKLKEKGKGIHGLRNFITNNVIESSRFVYLIKYANAQKIREVAKNEKVVMFVLGGIPDTQIERYYKSCVEFPDMNSSLEVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDNGDESPNLFLKKNKRLRKCVEVDINNADSNMTRKYRNCIAHLTVVRELKEYIGDIRTVDSYFSIYHYVMQRCITKREDDTKQEEKIKYEDDLLKNHGYTKDFVKALNSPFGYNIPRFKNLSIEQLFDRNEYLTEK

SEQ ID NO: 100 - protein, 929 aa, Artificial Sequence
  M13_gut_metagenome_P23C7k2120140920_c3000067
MAKKNKMKPRELREAQKKARQLKAAEINNNAAPAIAAMPAAQVIAPAAEKKKSSVKAAGMKSILVSENKMYITSFGKGNSAVLEYEVDKVDNNNYNKTQLSSKDNSNIELGDVNEVNITFSSKHGFESGVEINTSNPTHRSGESSPVRWDMLGLKSELEKRFFGKTFDDNIHIQLIYNILDIEKILAVYVTNIVYALNNMLGIKGSESYDDFMGYLSARNTYEVFTHPDKSNLSDKVKGNIKKSFSTFNDLLKTKRLGYFGLEEPKTKDTRVSEAYKKRVYHMLAIVGQIRQCVFHDLSEHSEYDLYSFIDNSKKVYRECRETLNYLVDERFDSINKGFIQGNKVNISLLIDMMKDDYEADDIIHLYYDFIVLKSQKNLGFSIKKLREKMLDEYGFRFKDKQYDSVRSKMYKLMDFLLFCNYYRNDVVAGEALVRKLRFSMTDDEKEGIYADEAEKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISEILKLKEKGKGIHGLRNFITNNVIESSRFVYLIKYANAQKIREVAKNEKVVMFVLGGIPDTQIERYYKSCVEFPDMNSSLKVKRSELARMIKNIRFDDFKNVKQQAKGRENVAKERAKAVIGLYLTVMYLLVKNLVNVNARYVIAIHCLERDFGLYKEIIPELASKNLKNDYRILSQTLCELCDDRDESPNLFLKKNRRLRKCVEVDINNADSSMTRKYRNCIAHLTVVRELKEYIGDIRTVDSYFSIYHYVMQRCITKREDDTKQEEKIKYEDDLLKNHGYTKDFVKALNSPFGYNIPRFKNLSIEQLFDRNEYLTEK

SEQ ID NO: 101 - protein, 923 aa, Artificial Sequence
  M5_gut_metagenome_P18E90k2120140920
MAKKNKMKPRELREAQKKARQLKAAEINNNAVPAIAAMPAAEVIAPAAEKKKSSVKAAGMKSILVSENKMYITSFGKGNSAVLEYEVDKVDDNDYNKTQLSSKDNSNIELGNVNEVNITFSSRRGFESGVEINTSNPTHRSGESSSVRGDMLGLKSELEKRFFGKTFDDNIHIQLIYNILDIEKILAVYVTNIVYALNNMLGVKGSESYDDFMGYLSAQNTYYIFTHPDKSNLSDKVKGNIKKSLSKFNDLLKTKRLGYFGLEEPKTKDKRVSEAYKKRVYHMLAIVGQIRQSVFHDKSNELDEYLYSFIDIIDSEYRDTLDYLVDERFDSINKGFIQGNKVNISLLIDMMKDDYEADDIIRLYYDFIVLKSQKNLGFSIKKLREKMLEEYGFRFKDKQYDSVRSKMYKIMDFLLFCNYYRNDVVAGEALVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDNITDDRISEILKLKEKGKGIHGLRNFITNNVIESSRFVYLIKYANAQKIREVAKNEKVVMFVLGGIPDTQIERYYKSCVEFPDMNSSLEVKRSELARMIKNICFDDFKNVKQQAKGRENVAKERAKAVIGLYLTVMYLLVKNLVNVNARYVIAIHCLERDFGLYKEIVSELASKNLKNDYRILSQTLCELCDKSPNLFLKKNERLRKCVEVDINNADSSMTRKYRNCIAHLTVVRELKEYIGDIRAVDSYFSIYHYVMQRCITKRGNDTKQEDKIKYEDDLLKNHGYTKDFVKALNSPFGYNIPRFKNLSIEQLFDRNEYLTEK

SEQ ID NO: 102 - protein, 923 aa, Artificial Sequence; identical to SEQ ID NO: 101
  M21_gut_metagenome_P18E0k2120140920

SEQ ID NO: 103 - protein, 926 aa, Artificial Sequence
  M7_gut_metagenome_P38C7k2120140920_c4841000003
  misc_feature (551)..(551): Xaa can be any naturally occurring amino acid
MAKKNKMKPRELREAQKKARQLKAAEINNNAAPAIAAMPAAEAIAPAAEKKKSSVKAAGMKSIFVSENKMYITSFGKGNSAVLEYEVDKVDNNVYNQTQLSSEDSSNIELCGVTKVNITFSSKHGLESGVEISTSNPTHRSGESSPVRWDMLGLKSELEKRFFGKTFDDNIHIQLIYNILDIEKILAVYVTNIVYALNNMLGIKDSESYDDFMGYLSARNTYKVFTHPDKSNLSDKVKGNIKKSFSTFNDLLKTKRLGYFGLEEPKTKDTRVSEAYKKRVYHMLAIVGQIRQCVFHDLSEHSEYDLYSFIDNSKKVYRECRETLNYLVDERFDSINKGFIQGNKVNISLLIDMMKDDYEADDIIHLYYDFIVLKSQKNLGFSIKKLREKMLDEYGFRFKDKQYDSVRSKMYKLMDFLLFCNYYRNDVVAGEALVRKLRFSMTDDEKEGIYADEAEKLWGKFRNDFENIADHMNGDVIKELGKADMDFDEKIIDSEKKNASDLLYFSKMIYMLTYFLDGKEINDLLTTLISKFDNIKEFLKIMKSSAVDVEXELTAGYKLFNDSQRITNELFIVKNIASMRKPAASAKLTMFRDALTILGIDDNITDDRISEILKLKEKGKGIHGLRNFITNNVIESSRFVYLIKYANAQKIREVAKNEKVVMFVLGGIPDTQIERYYKSCVEFPDMNSSLGVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYRNCIAHLTVVRELKEYIGDICTVDSYFSIYHYVMQRCITKRENDTKQEEKIKYEDDLLKNHGYTKDFVKALNSPFGYNIPRFKNLSIEQLFDRNEYLTEK

SEQ ID NO: 104 - protein, 918 aa, Artificial Sequence
  Ruminococcus_bicirculans
MAKKNKMKPRELREAQKKARQLKAAEINNNAVPAIAAMPAAEAAAPAAEKKKSSVKAAGMKSILVSENKMYITSFGKGNSAVLEYEVDNNDYNKTQLSSKDNSNIELCDVGKVNITFSSRRGFESGVEINTSNPTHRSGESSSVRGDMLGLKSELEKRFFGKNFDDNIHIQLIYNILDIEKILAVYVTNIVYALNNMLGEGDESNYDFMGYLSTFNTYKVFTNPNGSTLSDDKKENIRKSLSKFNALLKTKRLGYFGLEEPKTKDTRASEAYKKRVYHMLAIVGQIRQCVFHDKSGAKRFDLYSFINNIDPEYRETLDYLVDERFDSINKGFIQGNKVNISLLIDMMKGYEADDIIRLYYDFIVLKSQKNLGFSIKKLREKMLDEYGFRFKDKQYDSVRSKMYKLMDFLLFCNYYRNDIAAGESLVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISEILKLKEKGKGIHGLRNFITNNVIESSRFVYLIKYANAQKIREVAKNEKVVMFVLGGIPDTQIERYYKSCVEFPDMNSSLGVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYRNCIAHLTVVRELKEYIGDICTVDSYFSIYHYVMQRCITKRENDTKQEEKIKYEDDLLKNHGYTKDFVKALNSPFGYNIPRFKNLSIEQLFDRNEYLTEK

SEQ ID NO: 105 - protein, 920 aa, Artificial Sequence
  our_cloned_CAG_Ncas1
MAKKNKMKPRELREAQKKARQLKAAEINNNAAPAIAAMPAAEAAAPAAEKKKSSVKAAGMKSILVSENKMYITSFGKGNSAVLEYEVDNNDYNQTQLSSKGSSNIELHGVNEVNITFSSKHGFESGVEINTSNPTHRSGESSPVRWDMLGLKSELEKRFFGKTFDDNIHIQLIYNILDIEKILAVYVTNIVYALNNMLGVKGSESHDDFIGYLSTNNTYDVFIDPDNSSLSDDKKANVRKSLSKFNVLLKTKRLGYFGLEEPKTKDTRVSQAYKKRVYLAIVGQIRQCVFHDKSGAKRFDLYSFINNIDPEYRETLDYLVDERFDSINKGFIEGNKINISLLIDMMKGYEADDIIRLYYDFIVLKSQKNLGFSIKKLREKMLDEYGFRFKDKQYDPVRSKMYKLMDFLLFCNHYRNDVAAGEALVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDNITDDRISEILKLKEKGKGIHGLRNFITNNVIESSRFVYLIKYANAQKIREVAKNEKVVMFVLGGIPDTHIERYYKSCVEFPDMNSSLEAKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDDRDESPNLFLKKNKRLRKCVEVDINNADSSMTRKYRNCIAHLTVVRELKEYIGDIRTVDSYFSIYHYVMQRCITKRENDTKQEEKIKYEDDLLKNHGYTKDFVKALNSPFGYNIPRFKNLSIEQLFDRNEYLTEK

SEQ ID NO: 106 - protein, 922 aa, Artificial Sequence
  consensus_1
  misc_feature (89)..(89): Xaa can be any naturally occurring amino acid
  misc_feature (386)..(386): Xaa can be any naturally occurring amino acid
  misc_feature (789)..(790): Xaa can be any naturally occurring amino acid
MAKKNKMKPRELREAQKKARQLKAAEINNNAAPAIAAMPAAEVIAPAAEKKKSSVKAAGMKSILVSENKMYITSFGKGNSAVLEYEVDXNNDYNKTQLSSKDNSNIELGDVNEVNITFSSKHGFESGVEINTSNPTHRSGESSPVRWDMLGLKSELEKRFFGKTFDDNIHIQLIYNILDIEKILAVYVTNIVYALNNMLGIKGSESYDDFMGYLSARNTYDVFTHPDKSNLSDKVKGNIKKSLSKFNDLLKTKRLGYFGLEEPKTKDTRVSEAYKKRVYHMLAIVGQIRQCVFHDKSGAKRFDLYSFIDNIDPEYRDTLDYLVDERFDSINKGFIQGNKVNISLLIDMMKGYEADDIIRLYYDFIVLKSQKNLGFSIKKLREKMLXEYGFRFKDKQYDSVRSKMYKLMDFLLFCNYYRNDVVAGEALVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDNITDDRISEILKLKEKGKGIHGLRNFITNNVIESSRFVYLIKYANAQKIREVAKNEKVVMFVLGGIPDTQIERYYKSCVEFPDMNSSLEVKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDXXESPNLFLKKNKRLRKCVEVDINNADSSMTRKYRNCIAHLTVVRELKEYIGDIRTVDSYFSIYHYVMQRCITKREDDTKQEEKIKYEDDLLKNHGYTKDFVKALNSPFGYNIPRFKNLSIEQLFDRNEYLTEK

SEQ ID NO: 107 - protein, 922 aa, Artificial Sequence
  M18_gut_metagenome_P22E0k2120140920_c3395000078
MAKKNKMKPRELREAQKKARQLKAAEINNNAAPAIAAMPAAEVIAPVAEKKKSSVKAAGMKSILVSENKMYITSFGKGNSAVLEYEVDNNDYNKTQLSSKDNSNIELGDVNEVNITFSSKHGFGSGVEINTSNPTHRSGESSPVRGDMLGLKSELEKRFFGKTFDDNIHIQLIYNILDIEKILAVYVTNIVYALNNMLGIKDSESYDDFMGYLSARNTYEVFTHPDKSNLSDKVKGNIKKSLSKFNDLLKTKRLGYFGLEEPKTKDTRASEAYKKRVYHMLAIVGQIRQCVFHDKSGAKRFDLYSFINNIDPEYRDTLDYLVEERLKSINKDFIEGNKVNISLLIDMMKGYEADDIIRLYYDFIVLKSQKNLGFSIKKLREKMLEEYGFRFKDKQYDSVRSKMYKLMDFLLFCNYYRNDVAAGEALVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDNITDDRISEILKLKEKGKGIHGLRNFITNNVIESSRFVYLIKYANAQKIREVAKNEKVVMFVLGGIPDTQIERYYKSCVEFPDMNSSLEAKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDDRNESSNLFLKKNKRLRKCVEVDINNADSSMTRKYRNCIAHLTVVRELKEYIGDIRTVDSYFSIYHYVMQRCITKRGDDTKQEEKIKYEDDLLKNHGYTKDFVKALNSPFGYNIPRFKNLSIEQLFDRNEYLTEK

SEQ ID NO: 108 - protein, 922 aa, Artificial Sequence; identical to SEQ ID NO: 107
  M17_gut_metagenome_P22E90k2120140920_c114

SEQ ID NO: 109 - protein, 922 aa, Artificial Sequence
  Ruminococcus_sp_CAG57
MAKKNKMKPRELREAQKKARQLKAAEINNNAAPAIAAMPAAEVIAPVAEKKKSSVKAAGMKSILVSENKMYITSFGKGNSAVLEYEVDNNDYNKTQLSSKDNSNIELGDVNEVNITFSSKHGFGSGVEINTSNPTHRSGESSPVRGDMLGLKSELEKRFFGKTFDDNIHIQLIYNILDIEKILAVYVTNIVYALNNMLGIKDSESYDDFMGYLSARNTYEVFTHPDKSNLSDKVKGNIKKSLSKFNDLLKTKRLGYFGLEEPKTKDTRASEAYKKRVYHMLAIVGQIRQCVFHDKSGAKRFDLYSFINNIDPEYRDTLDYLVEERLKSINKDFIEGNKVNISLLIDMMKGYEADDIIRLYYDFIVLKSQKNLGFSIKKLREKMLEEYGFRFKDKQYDSVRSKMYKLMDFLLFCNYYRNDVAAGEALVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDNITDDRISEILKLKEKGKGIHGLRNFITNNVIESSRFVYLIKYANAQKIREVAKDEKVVMFVLGGIPDTQIERYYKSCVEFPDMNSSLEAKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDDRNESSNLFLKKNKRLRKCVEVDINNADSSMTRKYRNCIAHLTVVRELKEYIGDIRTVDSYFSIYHYVMQRCITKRGDDTKQEEKIKYEDDLLKNHGYTKDFVKALNSPFGYNIPRFKNLSIEQLFDRNEYLTEK

SEQ ID NO: 110 - protein, 531 aa, Artificial Sequence
  gut_metagenome_P11E90k2120140920_c43000123
FRFKDKQYDSVRSKMYKLMDFLLFCNYYRNDVVAGEALVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASARLTMFRDALTILGIDDKITDDRISEILKLKEKGKGIHGLRNFITNNVIESSRFVYLIKYANAQKIREVAKNEKVVMFVLGGIPDTQIERYYKSCVEFPDMNSSLEAKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDKSPNLFLKKNERLRKCVEVDINNADSSMTRKYRNCIAHLTVVRELKEYIGDIRTVDSYFSIYHYVMQRCITKRENDTKQEDKIKYEDDLLKNHGYTKDFVKALNSPFGYNIPRFKNLSIEQLFDRNEYLTEK

SEQ ID NO: 111 - protein, 925 aa, Artificial Sequence
  M6_gut_metagenome_P13E90k2120140920_c7000009
MAKKNKMKPRELREAQKKARQLKAAEIKNNAVPAIAAMPAAEAAAPAVEKKKSSVKAAGMKSILVSENKMYITSFGKGNSAVLEYEVDKVDNNNYNKTQLSSKDNSNIELGDVNEVNITFSSKRGNESGVEINTSNPTHRSGESSPVRWDMLGLKSELEKRFFGKTFDDNIHIQLIYNILDIEKILAVYVTNIVYALNNMLGIKGSESYDDFMGYLSARNTYEVFTHPDKSNLSDKVKGNIKKSLSKFNDLLKTKRLGYFGLEEPKTKDTRVSQAYKKRVYHMLAIVGQIRQCVFHDKSGAKRFDLYSFINNIDPEYRDTLDYLVEERLKSINKDFIEGNKVNISLLIDMMKGYEADDIIRLYYDFIVLKSQKNLGFSIKKLREKMLEEYGYRFKDKQYDSVRSKMYKLMDFLLFCNYYRNDVVAGEALVRKLRFSMTDDEKEGIYADEASKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISEILKLKEKGKGIHGLRNFITNNVIESSRFVYLIKYANAQKIREVAKNEKVVMFVLGGIPDTQIERYYKSCVEFPDMNSSLEAKRSELARMIKNIRFDDFKNVKQQAKGRENVAKERAKAVIGLYLTVMYLLVKNLVNVNARYVIAIHCLERDFGLYKEIIPELASKNLKNDYRILSQTLCELCDDRDESPNLFLKKNKRLRKCVEVDINNADSSMTRKYRNCIAHLTVVRELKEYIGDIRTVDSYFSIYHYVMQRCITKREDDTKQEEKIKYEDDLLKNHGYTKDFVKALNSPFGYNIPRFKNLSIEQLFDRNEYLTEK

SEQ ID NO: 112 - protein, 921 aa, Artificial Sequence
  M19_gut_metagenome_P17E90k2120140920
MAKKNKMKPRERREAQKKARQLKAAEINNNAVPAIAAMHAAEVIAPAAEKKKSSVKAAGMKSILVSENKMYITSFGKGNSAVLEYEVDNNDYNQTQLSSKDNSNIELCGVTKVNITFSSKHGFESGVEINTSNPTHRSGESSPVRGDMLGLKSELEKRFFGKTFDDNIHIQLIYNILDIEKILAVYVTNIVYALNNMLGEGDESNYDFMGYLSTFNTYKVFTNPNGSTLSDDKKENIRKSLSKFNALLKTKRLGYFGLEEPKTKDTRASEAYKKRVYHMLAIVGQIRQCVFHDKSGAKRFDLYSFINNIYPEYRDTLDYLVEERLKSINKDFIQGNKVNISLLIDMMKGYEADDIIRLYYDFIVLKSQKNLGFSIKKLREKMLDEYGFRFKDKQYDSVRSKMYKLMDFLLFCNYYRNDVVAGEALVRKLRFSMTDDEKEGIYADEAAKLWGKFRNDFENIADHMNGDVIKELGKADMDFDEKILDSEKKNASDLLYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISEILKLKEKGKGIHGLRNFITNNVIESSRFVYLIKYANAQKIREVAKNEKVVMFVLGGIPDTQIERYYKSCVEFPDMNSSLEAKRSELARMIKNISFDDFKNVKQQAKGRENVAKERAKAVIGLYLTVMYLLVKNLVNVNARYVIAIHCLERDFGLYKEIIPELASKNLKNDYRILSQTLCELCDDRDESPNLFLKKNKRLRKCVEVDINNADSSMTRKYRNCIAHLTVVRELKKYIGDIRTVDSYFSIYHYVMQRCITKREDDTKQEEKIKYEDDLLKNHGYTKDFVKALNSPFGYNIPRFKNLSIEQLFDRNEYLTEK

SEQ ID NO: 113 - protein, 234 aa, Artificial Sequence
  gut_metagenome_P17E0k2120140920,_c87000043
MYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISEILKLKEKGKGIHGLRNFITNNVIESSRFVYLIKYANAQKIREVAKNEKVVMFVLGGIPDTQIERYYKSCVEFPDMNSSLEAKRSELARMIKNISFDDFKNVKQQAKGRENVAKERAKAVIGLYLT

SEQ ID NO: 114 - DNA, 2859 bp, Artificial Sequence
  Human codon-optimized Eubacterium siraeum nCas1
ggcaagaagatccatgccagggacctcagggagcaaagaaagaccgataggacagaaaagttcgccgatcagaacaagaagagggaggctgagagagctgtgcccaaaaaagacgccgccgtctccgtgaagagcgtgtccagcgtcagcagcaagaaggacaacgtcaccaagagcatggccaaggccgccggagtgaagtccgtctttgctgtgggaaacaccgtgtacatgacctccttcggcaggggcaacgatgccgtgctggagcagaaaatcgtggacacctcccatgagcccctgaatatcgacgatcccgcctatcaactcaacgtggtgaccatgaatggatacagcgtcacaggccatagaggagagacagtgtccgccgtgacagataatcccctgaggagattcaacggcaggaagaaggacgaacccgagcagagcgtccctacagacatgctctgcctgaagcccaccctcgagaaaaaattttttggaaaggagtttgatgacaacattcatattcagctgatctataatatcctggatatcgagaaaatcctggccgtgtactccaccaacgccatctacgctctcaacaacatgtccgccgacgaaaacatcgagaactccgacttcttcatgaaaagaacaacagacgagacctttgacgacttcgagaagaagaaggagagcaccaacagcagagagaaagctgactttgacgcctttgaaaagttcatcggaaactataggctggcctatttcgctgacgctttctacgtgaataaaaagaaccccaagggaaaggccaagaatgtcctgagggaggacaaggagctctacagcgtgctgacactgatcggaaagctgagacactggtgtgtccacagcgaggaaggaagggctgaattctggctgtacaagctggacgagctcaaagacgatttcaagaacgtcctggatgtggtgtataacagacccgtggaggagatcaacaacaggttcatcgaaaataacaaagtcaacatccagatcctgggctccgtgtataagaacaccgacatcgccgagctggtgaggtcctactatgagttcctgatcaccaaaaaatacaagaatatgggcttttccatcaagaagctcagggagagcatgctggagggcaagggctacgctgataaggagtacgatagcgtgagaaataagctgtaccagatgaccgatttcatcctctacaccggctacatcaacgaagatagcgatagggctgacgacctggtgaacacactgaggagctccctcaaggaggacgacaaaacaaccgtctactgcaaggaggccgattacctgtggaaaaagtacagggaaagcattagagaagtcgccgatgccctggatggcgacaacattaagaagctgtccaagagcaatattgagattcaggaggataagctgagaaaatgtttcattagctatgctgatagcgtgagcgagtttaccaagctgatctacctcctcacaagattcctgagcggcaaggagatcaatgacctggtgaccaccctgatcaacaagttcgataatattagatcctttctggagattatggatgaactgggcctggacaggacatttaccgccgagtacagcttcttcgaaggctccacaaagtacctggccgagctcgtggagctgaatagctttgtgaagtcctgctccttcgacatcaatgccaagaggaccatgtacagggacgccctggatatcctgggcatcgagtccgacaagaccgaggaggatattgagaagatgattgataatatcctgcagatcgacgccaacggagataaaaagctgaagaaaaacaacggactgagaaacttcatcgcttccaacgtcatcgacagcaatagattcaaatacctggtcaggtacggcaaccccaagaagattagagagacagccaagtgcaagcccgctgtgaggttcgtgctgaacgaaattcccgacgcccagatcgaaaggtactatgaggcttgctgccccaagaacaccgccctctgcagcgccaataagagaagggagaagctggccgacatgatcgctgagatcaaattcgagaattttagcgatgccggcaattaccagaaggctaacgtcacatccaggaccagcgaggccgagatcaagagaaaaaaccaggccattattaggctctatctgacagtgatgtatattatgctgaaaaacctggtgaacgtgaatgccaggtacgtcattgccttccactgcgtggaaagggacaccaagctgtacgccgaaagcggcctggaagtgggcaacatcgaaaagaacaaaacaaacctcaccatggccgtgatgggagtgaaactcgaaaacggaattatcaagacagagttcgataagagcttcgccgagaacgccgctaacagatacctgaggaacgccaggtggtataaactgatcctggacaacctgaaaaaatccgagagagccgtggtgaatgagttcagaaataccgtgtgccacctgaatgccatcaggaacatcaatatcaacatcaaggaaattaaggaggtggagaattatttcgctctgtaccactacctgatccagaagcacctggagaacaggttcgccgataagaaggtggaaagggatacaggcgatttcatcagcaaactggaggagcacaagacctattgcaaagactttgtgaaggcttactgcaccccctttggctacaacctggtgagatataagaatctcaccattgacggcctcttcgacaagaactaccctggcaaggatgactccgatgagcagaag

SEQ ID NO: 115 - DNA, 2862 bp, Artificial Sequence
  Human codon-optimized Eubacterium siraeum nCas1 HEPN-/-
ggcaagaagatccatgccagggacctcagggagcaaagaaagaccgataggacagaaaagttcgccgatcagaacaagaagagggaggctgagagagctgtgcccaaaaaagacgccgccgtctccgtgaagagcgtgtccagcgtcagcagcaagaaggacaacgtcaccaagagcatggccaaggccgccggagtgaagtccgtctttgctgtgggaaacaccgtgtacatgacctccttcggcaggggcaacgatgccgtgctggagcagaaaatcgtggacacctcccatgagcccctgaatatcgacgatcccgcctatcaactcaacgtggtgaccatgaatggatacagcgtcacaggccatagaggagagacagtgtccgccgtgacagataatcccctgaggagattcaacggcaggaagaaggacgaacccgagcagagcgtccctacagacatgctctgcctgaagcccaccctcgagaaaaaattttttggaaaggagtttgatgacaacattcatattcagctgatctataatatcctggatatcgagaaaatcctggccgtgtactccaccaacgccatctacgctctcaacaacatgtccgccgacgaaaacatcgagaactccgacttcttcatgaaaagaacaacagacgagacctttgacgacttcgagaagaagaaggagagcaccaacagcagagagaaagctgactttgacgcctttgaaaagttcatcggaaactataggctggcctatttcgctgacgctttctacgtgaataaaaagaaccccaagggaaaggccaagaatgtcctgagggaggacaaggagctctacagcgtgctgacactgatcggaaagctggcacactggtgtgtcgccagcgaggaaggaagggctgaattctggctgtacaagctggacgagctcaaagacgatttcaagaacgtcctggatgtggtgtataacagacccgtggaggagatcaacaacaggttcatcgaaaataacaaagtcaacatccagatcctgggctccgtgtataagaacaccgacatcgccgagctggtgaggtcctactatgagttcctgatcaccaaaaaatacaagaatatgggcttttccatcaagaagctcagggagagcatgctggagggcaagggctacgctgataaggagtacgatagcgtgagaaataagctgtaccagatgaccgatttcatcctctacaccggctacatcaacgaagatagcgatagggctgacgacctggtgaacacactgaggagctccctcaaggaggacgacaaaacaaccgtctactgcaaggaggccgattacctgtggaaaaagtacagggaaagcattagagaagtcgccgatgccctggatggcgacaacattaagaagctgtccaagagcaatattgagattcaggaggataagctgagaaaatgtttcattagctatgctgatagcgtgagcgagtttaccaagctgatctacctcctcacaagattcctgagcggcaaggagatcaatgacctggtgaccaccctgatcaacaagttcgataatattagatcctttctggagattatggatgaactgggcctggacaggacatttaccgccgagtacagcttcttcgaaggctccacaaagtacctggccgagctcgtggagctgaatagctttgtgaagtcctgctccttcgacatcaatgccaagaggaccatgtacagggacgccctggatatcctgggcatcgagtccgacaagaccgaggaggatattgagaagatgattgataatatcctgcagatcgacgccaacggagataaaaagctgaagaaaaacaacggactgagaaacttcatcgcttccaacgtcatcgacagcaatagattcaaatacctggtcaggtacggcaaccccaagaagattagagagacagccaagtgcaagcccgctgtgaggttcgtgctgaacgaaattcccgacgcccagatcgaaaggtactatgaggcttgctgccccaagaacaccgccctctgcagcgccaataagagaagggagaagctggccgacatgatcgctgagatcaaattcgagaattttagcgatgccggcaattaccagaaggctaacgtcacatccaggaccagcgaggccgagatcaagagaaaaaaccaggccattattaggctctatctgacagtgatgtatattatgctgaaaaacctggtgaacgtgaatgccaggtacgtcattgccttccactgcgtggaaagggacaccaagctgtacgccgaaagcggcctggaagtgggcaacatcgaaaagaacaaaacaaacctcaccatggccgtgatgggagtgaaactcgaaaacggaattatcaagacagagttcgataagagcttcgccgagaacgccgctaacagatacctgaggaacgccaggtggtataaactgatcctggacaacctgaaaaaatccgagagagccgtggtgaatgagttcgcaaataccgtgtgcgccctgaatgccatcaggaacatcaatatcaacatcaaggaaattaaggaggtggagaattatttcgctctgtaccactacctgatccagaagcacctggagaacaggttcgccgataagaaggtggaaagggatacaggcgatttcatcagcaaactggaggagcacaagacctattgcaaagactttgtgaaggcttactgcaccccctttggctacaacctggtgagatataagaatctcaccattgacggcctcttcgacaagaactaccctggcaaggatgactccgatgagcagaagtga

SEQ ID NO: 116 - DNA, 2892 bp, Artificial Sequence
  Human codon-optimized Eubacterium siraeum nCas1 with N-terminal NLS
agccccaagaagaagagaaaggtggaggccagcggcaagaagatccatgccagggacctcagggagcaaagaaagaccgataggacagaaaagttcgccgatcagaacaagaagagggaggctgagagagctgtgcccaaaaaagacgccgccgtctccgtgaagagcgtgtccagcgtcagcagcaagaaggacaacgtcaccaagagcatggccaaggccgccggagtgaagtccgtctttgctgtgggaaacaccgtgtacatgacctccttcggcaggggcaacgatgccgtgctggagcagaaaatcgtggacacctcccatgagcccctgaatatcgacgatcccgcctatcaactcaacgtggtgaccatgaatggatacagcgtcacaggccatagaggagagacagtgtccgccgtgacagataatcccctgaggagattcaacggcaggaagaaggacgaacccgagcagagcgtccctacagacatgctctgcctgaagcccaccctcgagaaaaaattttttggaaaggagtttgatgacaacattcatattcagctgatctataatatcctggatatcgagaaaatcctggccgtgtactccaccaacgccatctacgctctcaacaacatgtccgccgacgaaaacatcgagaactccgacttcttcatgaaaagaacaacagacgagacctttgacgacttcgagaagaagaaggagagcaccaacagcagagagaaagctgactttgacgcctttgaaaagttcatcggaaactataggctggcctatttcgctgacgctttctacgtgaataaaaagaaccccaagggaaaggccaagaatgtcctgagggaggacaaggagctctacagcgtgctgacactgatcggaaagctgagacactggtgtgtccacagcgaggaaggaagggctgaattctggctgtacaagctggacgagctcaaagacgatttcaagaacgtcctggatgtggtgtataacagacccgtggaggagatcaacaacaggttcatcgaaaataacaaagtcaacatccagatcctgggctccgtgtataagaacaccgacatcgccgagctggtgaggtcctactatgagttcctgatcaccaaaaaatacaagaatatgggcttttccatcaagaagctcagggagagcatgctggagggcaagggctacgctgataaggagtacgatagcgtgagaaataagctgtaccagatgaccgatttcatcctctacaccggctacatcaacgaagatagcgatagggctgacgacctggtgaacacactgaggagctccctcaaggaggacgacaaaacaaccgtctactgcaaggaggccgattacctgtggaaaaagtacagggaaagcattagagaagtcgccgatgccctggatggcgacaacattaagaagctgtccaagagcaatattgagattcaggaggataagctgagaaaatgtttcattagctatgctgatagcgtgagcgagtttaccaagctgatctacctcctcacaagattcctgagcggcaaggagatcaatgacctggtgaccaccctgatcaacaagttcgataatattagatcctttctggagattatggatgaactgggcctggacaggacatttaccgccgagtacagcttcttcgaaggctccacaaagtacctggccgagctcgtggagctgaatagctttgtgaagtcctgctccttcgacatcaatgccaagaggaccatgtacagggacgccctggatatcctgggcatcgagtccgacaagaccgaggaggatattgagaagatgattgataatatcctgcagatcgacgccaacggagataaaaagctgaagaaaaacaacggactgagaaacttcatcgcttccaacgtcatcgacagcaatagattcaaatacctggtcaggtacggcaaccccaagaagattagagagacagccaagtgcaagcccgctgtgaggttcgtgctgaacgaaattcccgacgcccagatcgaaaggtactatgaggcttgctgccccaagaacaccgccctctgcagcgccaataagagaagggagaagctggccgacatgatcgctgagatcaaattcgagaattttagcgatgccggcaattaccagaaggctaacgtcacatccaggaccagcgaggccgagatcaagagaaaaaaccaggccattattaggctctatctgacagtgatgtatattatgctgaaaaacctggtgaacgtgaatgccaggtacgtcattgccttccactgcgtggaaagggacaccaagctgtacgccgaaagcggcctggaagtgggcaacatcgaaaagaacaaaacaaacctcaccatggccgtgatgggagtgaaactcgaaaacggaattatcaagacagagttcgataagagcttcgccgagaacgccgctaacagatacctgaggaacgccaggtggtataaactgatcctggacaacctgaaaaaatccgagagagccgtggtgaatgagttcagaaataccgtgtgccacctgaatgccatcaggaacatcaatatcaacatcaaggaaattaaggaggtggagaattatttcgctctgtaccactacctgatccagaagcacctggagaacaggttcgccgataagaaggtggaaagggatacaggcgatttcatcagcaaactggaggagcacaagacctattgcaaagactttgtgaaggcttactgcaccccctttggctacaacctggtgagatataagaatctcaccattgacggcctcttcgacaagaactaccctggcaaggatgactccgatgagcagaag

SEQ ID NO: 117 - DNA, 2931 bp, Artificial Sequence
  Human codon-optimized Eubacterium siraeum nCas1 with N- and C-terminal NLS tags
agccccaagaagaagagaaaggtggaggccagcggcaagaagatccatgccagggacctcagggagcaaagaaagaccgataggacagaaaagttcgccgatcagaacaagaagagggaggctgagagagctgtgcccaaaaaagacgccgccgtctccgtgaagagcgtgtccagcgtcagcagcaagaaggacaacgtcaccaagagcatggccaaggccgccggagtgaagtccgtctttgctgtgggaaacaccgtgtacatgacctccttcggcaggggcaacgatgccgtgctggagcagaaaatcgtggacacctcccatgagcccctgaatatcgacgatcccgcctatcaactcaacgtggtgaccatgaatggatacagcgtcacaggccatagaggagagacagtgtccgccgtgacagataatcccctgaggagattcaacggcaggaagaaggacgaacccgagcagagcgtccctacagacatgctctgcctgaagcccaccctcgagaaaaaattttttggaaaggagtttgatgacaacattcatattcagctgatctataatatcctggatatcgagaaaatcctggccgtgtactccaccaacgccatctacgctctcaacaacatgtccgccgacgaaaacatcgagaactccgacttcttcatgaaaagaacaacagacgagacctttgacgacttcgagaagaagaaggagagcaccaacagcagagagaaagctgactttgacgcctttgaaaagttcatcggaaactataggctggcctatttcgctgacgctttctacgtgaataaaaagaaccccaagggaaaggccaagaatgtcctgagggaggacaaggagctctacagcgtgctgacactgatcggaaagctgagacactggtgtgtccacagcgaggaaggaagggctgaattctggctgtacaagctggacgagctcaaagacgatttcaagaacgtcctggatgtggtgtataacagacccgtggaggagatcaacaacaggttcatcgaaaataacaaagtcaacatccagatcctgggctccgtgtataagaacaccgacatcgccgagctggtgaggtcctactatgagttcctgatcaccaaaaaatacaagaatatgggcttttccatcaagaagctcagggagagcatgctggagggcaagggctacgctgataaggagtacgatagcgtgagaaataagctgtaccagatgaccgatttcatcctctacaccggctacatcaacgaagatagcgatagggctgacgacctggtgaacacactgaggagctccctcaaggaggacgacaaaacaaccgtctactgcaaggaggccgattacctgtggaaaaagtacagggaaagcattagagaagtcgccgatgccctggatggcgacaacattaagaagctgtccaagagcaatattgagattcaggaggataagctgagaaaatgtttcattagctatgctgatagcgtgagcgagtttaccaagctgatctacctcctcacaagattcctgagcggcaaggagatcaatgacctggtgaccaccctgatcaacaagttcgataatattagatcctttctggagattatggatgaactgggcctggacaggacatttaccgccgagtacagcttcttcgaaggctccacaaagtacctggccgagctcgtggagctgaatagctttgtgaagtcctgctccttcgacatcaatgccaagaggaccatgtacagggacgccctggatatcctgggcatcgagtccgacaagaccgaggaggatattgagaagatgattgataatatcctgcagatcgacgccaacggagataaaaagctgaagaaaaacaacggactgagaaacttcatcgcttccaacgtcatcgacagcaatagattcaaatacctggtcaggtacggcaaccccaagaagattagagagacagccaagtgcaagcccgctgtgaggttcgtgctgaacgaaattcccgacgcccagatcgaaaggtactatgaggcttgctgccccaagaacaccgccctctgcagcgccaataagagaagggagaagctggccgacatgatcgctgagatcaaattcgagaattttagcgatgccggcaattaccagaaggctaacgtcacatccaggaccagcgaggccgagatcaagagaaaaaaccaggccattattaggctctatctgacagtgatgtatattatgctgaaaaacctggtgaacgtgaatgccaggtacgtcattgccttccactgcgtggaaagggacaccaagctgtacgccgaaagcggcctggaagtgggcaacatcgaaaagaacaaaacaaacctcaccatggccgtgatgggagtgaaactcgaaaacggaattatcaagacagagttcgataagagcttcgccgagaacgccgctaacagatacctgaggaacgccaggtggtataaactgatcctggacaacctgaaaaaatccgagagagccgtggtgaatgagttcagaaataccgtgtgccacctgaatgccatcaggaacatcaatatcaacatcaaggaaattaaggaggtggagaattatttcgctctgtaccactacctgatccagaagcacctggagaacaggttcgccgataagaaggtggaaagggatacaggcgatttcatcagcaaactggaggagcacaagacctattgcaaagactttgtgaaggcttactgcaccccctttggctacaacctggtgagatataagaatctcaccattgacggcctcttcgacaagaactaccctggcaaggatgactccgatgagcagaagggatccggacctaagaaaaagaggaaggtggcggccgct

SEQ ID NO: 118 - DNA, 2754 bp, Artificial Sequence
  Human codon-optimized uncultured Ruminococcus sp. nCas1
gccaagaagaacaagatgaaacccagggagctgagagaggctcagaagaaggctaggcaactgaaagccgccgagatcaataacaatgccgcccctgccatcgccgctatgcccgctgccgaagtcatcgctcccgccgccgaaaagaagaagagctccgtgaaagccgctggaatgaagtccattctggtgtccgagaacaaaatgtatatcacctccttcggcaaaggcaattccgctgtgctggagtatgaggtggacaacaacgactacaatcagacccagctcagcagcaaggataactccaacatccagctgggcggcgtgaatgaagtgaatatcaccttcagcagcaagcacggatttgagtccggagtcgagattaacacaagcaaccctacccacaggtccggagaaagcagccctgtcagaggagacatgctgggactgaaaagcgagctggagaagagattctttggaaagacctttgatgacaatatccacatccagctcatttacaacatcctggatatcgagaaaatcctggccgtgtatgtgaccaacatcgtgtacgctctgaacaacatgctcggcgtcaagggcagcgagtcccacgacgactttattggctatctgtccaccaacaatatttacgatgtcttcattgaccccgacaacagcagcctctccgacgacaaaaaagccaacgtcaggaagagcctcagcaaattcaacgccctgctgaagaccaagaggctcggatactttggcctggaggaacccaagaccaaggacaacagagtgagccaggcctataagaaaagggtgtaccacatgctggccatcgtgggccagatcagacagtgcgtgttccatgacaagtccggcgccaagagattcgacctgtactccttcattaacaacatcgaccctgagtacagggatacactggattacctcgtggaggagaggctgaagagcatcaacaaagactttattgaggacaacaaagtcaacatcagcctgctgatcgatatgatgaagggctacgaagctgacgacatcatcaggctgtactatgatttcattgtcctgaagagccagaagaacctgggattctccattaagaaactgagagaaaagatgctcgacgagtacggcttcaggttcaaggacaagcagtatgacagcgtgagatccaagatgtacaagctgatggattttctcctgttttgcaactattacaggaacgacatcgccgccggcgaatccctggtcaggaaactgagattcagcatgaccgacgacgagaaggaaggcatctacgccgacgaagccgctaagctgtggggaaaatttagaaatgacttcgagaacatcgctgaccacatgaacggcgatgtgatcaaggagctcggcaaggctgacatggatttcgacgagaagatcctggattccgagaagaagaatgccagcgatctgctgtacttcagcaagatgatttacatgctcacatattttctcgatggcaaggagatcaacgatctcctgaccacactgatcagcaagttcgacaacattaaagagttcctcaaaattatgaaatccagcgccgtggatgtcgagtgcgaactcaccgccggctacaagctcttcaacgacagccagaggatcaccaatgagctgttcattgtgaaaaatatcgctagcatgaggaaacccgccgcctccgctaaactgacaatgtttagagatgccctcaccatcctgggcatcgacgataagatcacagacgacagaattagcggaatcctgaagctcaaggaaaagggcaagggaatccatggcctcagaaatttcattaccaataacgtgatcgaaagcagcaggttcgtgtatctgatcaagtacgccaatgcccaaaagatcagggaggtggccaagaacgaaaaggtggtgatgttcgtgctgggcggcattcctgacacacagatcgaaaggtactacaagagctgtgtggagttccccgatatgaactccagcctgggcgtgaagagatccgaactggctaggatgatcaagaatattagcttcgacgacttcaagaacgtgaagcaacaggccaaaggaagggagaacgtcgccaaagagagagccaaggccgtgatcggactctacctgaccgtcatgtacctcctcgtgaagaacctggtgaacgtgaacgctagatacgtcatcgccatccattgcctcgagagggacttcggactgtacaaggagatcattcccgagctggccagcaaaaatctcaagaacgattacagaatcctgagccaaaccctgtgcgagctgtgtgacaagtcccccaacctgtttctgaagaagaatgaaaggctgagaaagtgcgtcgaagtcgacatcaacaacgctgacagctccatgaccaggaaatacaggaactgtatcgcccatctgaccgtggtgagggaactcaaggagtacatcggagatatctgcaccgtggactcctacttcagcatttatcactacgtgatgcagaggtgcattaccaagagagaaaatgacacaaagcaggaggagaagattaagtacgaggacgatctgctgaaaaaccacggatacaccaaggatttcgtcaaggccctcaatagccccttcggctacaatatccctaggtttaaaaacctgagcatcgagcagctgtttgacagaaatgaatacctgacagagaag

SEQ ID NO: 119 - DNA, 2757 bp, Artificial Sequence
  Human codon-optimized uncultured Ruminococcus sp. nCas1 HEPN-/-
atggccaagaagaacaagatgaaacccagggagctgagagaggctcagaagaaggctaggcaactgaaagccgccgagatcaataacaatgccgcccctgccatcgccgctatgcccgctgccgaagtcatcgctcccgccgccgaaaagaagaagagctccgtgaaagccgctggaatgaagtccattctggtgtccgagaacaaaatgtatatcacctccttcggcaaaggcaattccgctgtgctggagtatgaggtggacaacaacgactacaatcagacccagctcagcagcaaggataactccaacatccagctgggcggcgtgaatgaagtgaatatcaccttcagcagcaagcacggatttgagtccggagtcgagattaacacaagcaaccctacccacaggtccggagaaagcagccctgtcagaggagacatgctgggactgaaaagcgagctggagaagagattctttggaaagacctttgatgacaatatccacatccagctcatttacaacatcctggatatcgagaaaatcctggccgtgtatgtgaccaacatcgtgtacgctctgaacaacatgctcggcgtcaagggcagcgagtcccacgacgactttattggctatctgtccaccaacaatatttacgatgtcttcattgaccccgacaacagcagcctctccgacgacaaaaaagccaacgtcaggaagagcctcagcaaattcaacgccctgctgaagaccaagaggctcggatactttggcctggaggaacccaagaccaaggacaacagagtgagccaggcctataagaaaagggtgtaccacatgctggccatcgtgggccagatcgcacagtgcgtgttcgctgacaagtccggcgccaagagattcgacctgtactccttcattaacaacatcgaccctgagtacagggatacactggattacctcgtggaggagaggctgaagagcatcaacaaagactttattgaggacaacaaagtcaacatcagcctgctgatcgatatgatgaagggctacgaagctgacgacatcatcaggctgtactatgatttcattgtcctgaagagccagaagaacctgggattctccattaagaaactgagagaaaagatgctcgacgagtacggcttcaggttcaaggacaagcagtatgacagcgtgagatccaagatgtacaagctgatggattttctcctgttttgcaactattacaggaacgacatcgccgccggcgaatccctggtcaggaaactgagattcagcatgaccgacgacgagaaggaaggcatctacgccgacgaagccgctaagctgtggggaaaatttagaaatgacttcgagaacatcgctgaccacatgaacggcgatgtgatcaaggagctcggcaaggctgacatggatttcgacgagaagatcctggattccgagaagaagaatgccagcgatctgctgtacttcagcaagatgatttacatgctcacatattttctcgatggcaaggagatcaacgatctcctgaccacactgatcagcaagttcgacaacattaaagagttcctcaaaattatgaaatccagcgccgtggatgtcgagtgcgaactcaccgccggctacaagctcttcaacgacagccagaggatcaccaatgagctgttcattgtgaaaaatatcgctagcatgaggaaacccgccgcctccgctaaactgacaatgtttagagatgccctcaccatcctgggcatcgacgataagatcacagacgacagaattagcggaatcctgaagctcaaggaaaagggcaagggaatccatggcctcagaaatttcattaccaataacgtgatcgaaagcagcaggttcgtgtatctgatcaagtacgccaatgcccaaaagatcagggaggtggccaagaacgaaaaggtggtgatgttcgtgctgggcggcattcctgacacacagatcgaaaggtactacaagagctgtgtggagttccccgatatgaactccagcctgggcgtgaagagatccgaactggctaggatgatcaagaatattagcttcgacgacttcaagaacgtgaagcaacaggccaaaggaagggagaacgtcgccaaagagagagccaaggccgtgatcggactctacctgaccgtcatgtacctcctcgtgaagaacctggtgaacgtgaacgctagatacgtcatcgccatccattgcctcgagagggacttcggactgtacaaggagatcattcccgagctggccagcaaaaatctcaagaacgattacagaatcctgagccaaaccctgtgcgagctgtgtgacaagtcccccaacctgtttctgaagaagaatgaaaggctgagaaagtgcgtcgaagtcgacatcaacaacgctgacagctccatgaccaggaaatacgcgaactgtatcgccgctctgaccgtggtgagggaactcaaggagtacatcggagatatctgcaccgtggactcctacttcagcatttatcactacgtgatgcagaggtgcattaccaagagagaaaatgacacaaagcaggaggagaagattaagtacgaggacgatctgctgaaaaaccacggatacaccaaggatttcgtcaaggccctcaatagccccttcggctacaatatccctaggtttaaaaacctgagcatcgagcagctgtttgacagaaatgaatacctgacagagaag

SEQ ID NO: 120 - DNA, 2787 bp, Artificial Sequence
  Human codon-optimized uncultured Ruminococcus sp. nCas1 with N-terminal NLS
agccccaagaagaagagaaaggtggaggccagcgccaagaagaacaagatgaaacccagggagctgagagaggctcagaagaaggctaggcaactgaaagccgccgagatcaataacaatgccgcccctgccatcgccgctatgcccgctgccgaagtcatcgctcccgccgccgaaaagaagaagagctccgtgaaagccgctggaatgaagtccattctggtgtccgagaacaaaatgtatatcacctccttcggcaaaggcaattccgctgtgctggagtatgaggtggacaacaacgactacaatcagacccagctcagcagcaaggataactccaacatccagctgggcggcgtgaatgaagtgaatatcaccttcagcagcaagcacggatttgagtccggagtcgagattaacacaagcaaccctacccacaggtccggagaaagcagccctgtcagaggagacatgctgggactgaaaagcgagctggagaagagattctttggaaagacctttgatgacaatatccacatccagctcatttacaacatcctggatatcgagaaaatcctggccgtgtatgtgaccaacatcgtgtacgctctgaacaacatgctcggcgtcaagggcagcgagtcccacgacgactttattggctatctgtccaccaacaatatttacgatgtcttcattgaccccgacaacagcagcctctccgacgacaaaaaagccaacgtcaggaagagcctcagcaaattcaacgccctgctgaagaccaagaggctcggatactttggcctggaggaacccaagaccaaggacaacagagtgagccaggcctataagaaaagggtgtaccacatgctggccatcgtgggccagatcagacagtgcgtgttccatgacaagtccggcgccaagagattcgacctgtactccttcattaacaacatcgaccctgagtacagggatacactggattacctcgtggaggagaggctgaagagcatcaacaaagactttattgaggacaacaaagtcaacatcagcctgctgatcgatatgatgaagggctacgaagctgacgacatcatcaggctgtactatgatttcattgtcctgaagagccagaagaacctgggattctccattaagaaactgagagaaaagatgctcgacgagtacggcttcaggttcaaggacaagcagtatgacagcgtgagatccaagatgtacaagctgatggattttctcctgttttgcaactattacaggaacgacatcgccgccggcgaatccctggtcaggaaactgagattcagcatgaccgacgacgagaaggaaggcatctacgccgacgaagccgctaagctgtggggaaaatttagaaatgacttcgagaacatcgctgaccacatgaacggcgatgtgatcaaggagctcggcaaggctgacatggatttcgacgagaagatcctggattccgagaagaagaatgccagcgatctgctgtacttcagcaagatgatttacatgctcacatattttctcgatggcaaggagatcaacgatctcctgaccacactgatcagcaagttcgacaacattaaagagttcctcaaaattatgaaatccagcgccgtggatgtcgagtgcgaactcaccgccggctacaagctcttcaacgacagccagaggatcaccaatgagctgttcattgtgaaaaatatcgctagcatgaggaaacccgccgcctccgctaaactgacaatgtttagagatgccctcaccatcctgggcatcgacgataagatcacagacgacagaattagcggaatcctgaagctcaaggaaaagggcaagggaatccatggcctcagaaatttcattaccaataacgtgatcgaaagcagcaggttcgtgtatctgatcaagtacgccaatgcccaaaagatcagggaggtggccaagaacgaaaaggtggtgatgttcgtgctgggcggcattcctgacacacagatcgaaaggtactacaagagctgtgtggagttccccgatatgaactccagcctgggcgtgaagagatccgaactggctaggatgatcaagaatattagcttcgacgacttcaagaacgtgaagcaacaggccaaaggaagggagaacgtcgccaaagagagagccaaggccgtgatcggactctacctgaccgtcatgtacctcctcgtgaagaacctggtgaacgtgaacgctagatacgtcatcgccatccattgcctcgagagggacttcggactgtacaaggagatcattcccgagctggccagcaaaaatctcaagaacgattacagaatcctgagccaaaccctgtgcgagctgtgtgacaagtcccccaacctgtttctgaagaagaatgaaaggctgagaaagtgcgtcgaagtcgacatcaacaacgctgacagctccatgaccaggaaatacaggaactgtatcgcccatctgaccgtggtgagggaactcaaggagtacatcggagatatctgcaccgtggactcctacttcagcatttatcactacgtgatgcagaggtgcattaccaagagagaaaatgacacaaagcaggaggagaagattaagtacgaggacgatctgctgaaaaaccacggatacaccaaggatttcgtcaaggccctcaatagccccttcggctacaatatccctaggtttaaaaacctgagcatcgagcagctgtttgacagaaatgaatacctgacagagaag

SEQ ID NO: 121 - DNA, 2826 bp, Artificial Sequence
  Human codon-optimized uncultured Ruminococcus sp. nCas1 with N- and C-terminal NLS tags
agccccaagaagaagagaaaggtggaggccagcgccaagaagaacaagatgaaacccagggagctgagagaggctcagaagaaggctaggcaactgaaagccgccgagatcaataacaatgccgcccctgccatcgccgctatgcccgctgccgaagtcatcgctcccgccgccgaaaagaagaagagctccgtgaaagccgctggaatgaagtccattctggtgtccgagaacaaaatgtatatcacctccttcggcaaaggcaattccgctgtgctggagtatgaggtggacaacaacgactacaatcagacccagctcagcagcaaggataactccaacatccagctgggcggcgtgaatgaagtgaatatcaccttcagcagcaagcacggatttgagtccggagtcgagattaacacaagcaaccctacccacaggtccggagaaagcagccctgtcagaggagacatgctgggactgaaaagcgagctggagaagagattctttggaaagacctttgatgacaatatccacatccagctcatttacaacatcctggatatcgagaaaatcctggccgtgtatgtgaccaacatcgtgtacgctctgaacaacatgctcggcgtcaagggcagcgagtcccacgacgactttattggctatctgtccaccaacaatatttacgatgtcttcattgaccccgacaacagcagcctctccgacgacaaaaaagccaacgtcaggaagagcctcagcaaattcaacgccctgctgaagaccaagaggctcggatactttggcctggaggaacccaagaccaaggacaacagagtgagccaggcctataagaaaagggtgtaccacatgctggccatcgtgggccagatcagacagtgcgtgttccatgacaagtccggcgccaagagattcgacctgtactccttcattaacaacatcgaccctgagtacagggatacactggattacctcgtggaggagaggctgaagagcatcaacaaagactttattgaggacaacaaagtcaacatcagcctgctgatcgatatgatgaagggctacgaagctgacgacatcatcaggctgtactatgatttcattgtcctgaagagccagaagaacctgggattctccattaagaaactgagagaaaagatgctcgacgagtacggcttcaggttcaaggacaagcagtatgacagcgtgagatccaagatgtacaagctgatggattttctcctgttttgcaactattacaggaacgacatcgccgccggcgaatccctggtcaggaaactgagattcagcatgaccgacgacgagaaggaaggcatctacgccgacgaagccgctaagctgtggggaaaatttagaaatgacttcgagaacatcgctgaccacatgaacggcgatgtgatcaaggagctcggcaaggctgacatggatttcgacgagaagatcctggattccgagaagaagaatgccagcgatctgctgtacttcagcaagatgatttacatgctcacatattttctcgatggcaaggagatcaacgatctcctgaccacactgatcagcaagttcgacaacattaaagagttcctcaaaattatgaaatccagcgccgtggatgtcgagtgcgaactcaccgccggctacaagctcttcaacgacagccagaggatcaccaatgagctgttcattgtgaaaaatatcgctagcatgaggaaacccgccgcctccgctaaactgacaatgtttagagatgccctcaccatcctgggcatcgacgataagatcacagacgacagaattagcggaatcctgaagctcaaggaaaagggcaagggaatccatggcctcagaaatttcattaccaataacgtgatcgaaagcagcaggttcgtgtatctgatcaagtacgccaatgcccaaaagatcagggaggtggccaagaacgaaaaggtggtgatgttcgtgctgggcggcattcctgacacacagatcgaaaggtactacaagagctgtgtggagttccccgatatgaactccagcctgggcgtgaagagatccgaactggctaggatgatcaagaatattagcttcgacgacttcaagaacgtgaagcaacaggccaaaggaagggagaacgtcgccaaagagagagccaaggccgtgatcggactctacctgaccgtcatgtacctcctcgtgaagaacctggtgaacgtgaacgctagatacgtcatcgccatccattgcctcgagagggacttcggactgtacaaggagatcattcccgagctggccagcaaaaatctcaagaacgattacagaatcctgagccaaaccctgtgcgagctgtgtgacaagtcccccaacctgtttctgaagaagaatgaaaggctgagaaagtgcgtcgaagtcgacatcaacaacgctgacagctccatgaccaggaaatacaggaactgtatcgcccatctgaccgtggtgagggaactcaaggagtacatcggagatatctgcaccgtggactcctacttcagcatttatcactacgtgatgcagaggtgcattaccaagagagaaaatgacacaaagcaggaggagaagattaagtacgaggacgatctgctgaaaaaccacggatacaccaaggatttcgtcaaggccctcaatagccccttcggctacaatatccctaggtttaaaaacctgagcatcgagcagctgtttgacagaaatgaatacctgacagagaagggatccggacctaagaaaaagaggaaggtggcggccgct

SEQ ID NO: 122 - DNA, 2803 bp, Artificial Sequence
  Human codon-optimized Ruminococcus flavefaciens FD1 nCas1
aagaaaaaaatgagcctcagagagaagagggaagccgagaaacaagccaaaaaagccgcctacagcgctgcctccaaaaacacagatagcaaacctgctgagaagaaggccgagacacccaagcctgctgagattatttccgacaactccagaaacaaaaccgccgtcaaggccgccggcctgaaatccacaattatctccggcgataagctgtacatgaccagcttcggaaagggcaacgccgccgtgatcgagcagaaaattgatattaatgattactccttctccgccatgaaggatacccccagcctggaagtggacaaggccgagagcaaggagatctccttctccagccaccacccttttgtcaaaaatgataaactgaccacctataatcccctgtacggcggaaaagataaccccgaaaagcccgtgggcagagatatgctcggcctcaaagacaagctcgaggagaggtacttcggatgcaccttcaatgacaacctgcacattcagattatctataacatcctcgacattgagaaaattctggccgtgcactccgccaacattaccacagctctggaccacatggtggacgaggacgatgagaagtacctcaatagcgattacattggctacatgaacaccatcaacacctatgatgtgttcatggacccctccaaaaattcctccctctcccccaaggacaggaagaacattgataacagcagggccaagtttgagaagctcctgtccacaaagaggctcggctactttggctttgactacgatgccaacggcaaggataagaagaaaaacgaggagatcaagaaaaggctctatcacctgacagcctttgccggccagctcaggcagtggtccttccatagcgccggcaattatcccagaacctggctctacaagctcgatagcctggacaaagagtatctcgacaccctggaccattattttgataagagattcaacgatattaatgacgatttcgtcaccaagaacgccacaaacctgtacatcctgaaggaggtcttccccgaggctaatttcaaggatatcgccgatctctactacgatttcattgtcatcaaaagccataagaatatgggattttccatcaagaagctgagggagaagatgctggagtgcgatggagctgatagaatcaaggaacaggacatggactccgtgaggagcaagctgtataagctgatcgatttttgcattttcaaatactaccacgagttccctgagctgagcgagaagaacgtcgacatcctcagggctgccgtgagcgataccaaaaaggacaacctgtatagcgacgaggccgctaggctctggagcatcttcaaggaaaagttcctgggcttctgcgacaagattgtggtgtgggtgaccggcgagcacgagaaagacatcacctccgtgattgacaaggacgcttacaggaacaggtccaacgtgagctacttttccaagctgatgtacgccatgtgtttcttcctggatggaaaggaaattaacgatctgctgaccacactgatcaacaaattcgacaacattgccaaccagatcaagaccgccaaggagctcggcattaacaccgccttcgtgaaaaactacgattttttcaaccacagcgaaaagtacgtggacgagctgaacattgtgaaaaacatcgccaggatgaaaaagccctccagcaacgccaagaaggccatgtaccatgacgccctgacaatcctgggcatccccgaggatatggacgagaaggccctggatgaggagctcgatctcatcctggaaaagaagaccgatcccgtgaccggaaagcccctcaaaggcaaaaatcccctgaggaattttatcgctaataatgtgattgagaatagcaggttcatttacctgattaaattttgcaaccctgagaatgtcaggaaaatcgtgaacaacacaaaggtgaccgagttcgtgctcaagaggatccccgatgcccagatcgagaggtactacaagagctgtaccgattccgagatgaaccctcccacagaaaagaagatcaccgagctggccggcaagctgaaagatatgaattttggaaacttcaggaacgtgaggcagtccgccaaggaaaacatggagaaagagaggttcaaggccgtcattggcctgtacctcaccgtcgtctacagagtggtcaaaaacctggtggacgtcaatagcaggtacatcatggccttccatagcctggagagagattcccagctgtacaacgtgagcgtcgataatgattacctggccctcaccgacaccctggtcaaggagggcgacaacagcaggtccaggtacctggccggaaataaaaggctgagggattgcgtgaagcaagacatcgacaatgccaaaaagtggttcgtctccgacaagtacaactccattacaaagtacaggaacaacgtggcccacctgaccgccgtgagaaactgcgccgagttcatcggcgacattaccaagatcgactcctacttcgccctctaccactacctcattcagagacagctggctaagggcctcgatcatgagaggtccggattcgacaggaattacccccagtacgcccctctgttcaaatggcacacctacgtgaaggatgtcgtcaaggccctgaacgcccccttcggatacaatatccctaggttcaagaatctgagcatcgacgccctctttgataggaatgaaatcaagaagaacgatggcgagaagaagtccgacgactgagcct

SEQ ID NO: 123 - DNA, 2799 bp, Artificial Sequence
  Human codon-optimized Ruminococcus flavefaciens FD1 nCas1 HEPN-/-
aagaaaaaaatgagcctcagagagaagagggaagccgagaaacaagccaaaaaagccgcctacagcgctgcctccaaaaacacagatagcaaacctgctgagaagaaggccgagacacccaagcctgctgagattatttccgacaactccagaaacaaaaccgccgtcaaggccgccggcctgaaatccacaattatctccggcgataagctgtacatgaccagcttcggaaagggcaacgccgccgtgatcgagcagaaaattgatattaatgattactccttctccgccatgaaggatacccccagcctggaagtggacaaggccgagagcaaggagatctccttctccagccaccacccttttgtcaaaaatgataaactgaccacctataatcccctgtacggcggaaaagataaccccgaaaagcccgtgggcagagatatgctcggcctcaaagacaagctcgaggagaggtacttcggatgcaccttcaatgacaacctgcacattcagattatctataacatcctcgacattgagaaaattctggccgtgcactccgccaacattaccacagctctggaccacatggtggacgaggacgatgagaagtacctcaatagcgattacattggctacatgaacaccatcaacacctatgatgtgttcatggacccctccaaaaattcctccctctcccccaaggacaggaagaacattgataacagcagggccaagtttgagaagctcctgtccacaaagaggctcggctactttggctttgactacgatgccaacggcaaggataagaagaaaaacgaggagatcaagaaaaggctctatcacctgacagcctttgccggccagctcgcgcagtggtccttcgctagcgccggcaattatcccagaacctggctctacaagctcgatagcctggacaaagagtatctcgacaccctggaccattattttgataagagattcaacgatattaatgacgatttcgtcaccaagaacgccacaaacctgtacatcctgaaggaggtcttccccgaggctaatttcaaggatatcgccgatctctactacgatttcattgtcatcaaaagccataagaatatgggattttccatcaagaagctgagggagaagatgctggagtgcgatggagctgatagaatcaaggaacaggacatggactccgtgaggagcaagctgtataagctgatcgatttttgcattttcaaatactaccacgagttccctgagctgagcgagaagaacgtcgacatcctcagggctgccgtgagcgataccaaaaaggacaacctgtatagcgacgaggccgctaggctctggagcatcttcaaggaaaagttcctgggcttctgcgacaagattgtggtgtgggtgaccggcgagcacgagaaagacatcacctccgtgattgacaaggacgcttacaggaacaggtccaacgtgagctacttttccaagctgatgtacgccatgtgtttcttcctggatggaaaggaaattaacgatctgctgaccacactgatcaacaaattcgacaacattgccaaccagatcaagaccgccaaggagctcggcattaacaccgccttcgtgaaaaactacgattttttcaaccacagcgaaaagtacgtggacgagctgaacattgtgaaaaacatcgccaggatgaaaaagccctccagcaacgccaagaaggccatgtaccatgacgccctgacaatcctgggcatccccgaggatatggacgagaaggccctggatgaggagctcgatctcatcctggaaaagaagaccgatcccgtgaccggaaagcccctcaaaggcaaaaatcccctgaggaattttatcgctaataatgtgattgagaatagcaggttcatttacctgattaaattttgcaaccctgagaatgtcaggaaaatcgtgaacaacacaaaggtgaccgagttcgtgctcaagaggatccccgatgcccagatcgagaggtactacaagagctgtaccgattccgagatgaaccctcccacagaaaagaagatcaccgagctggccggcaagctgaaagatatgaattttggaaacttcaggaacgtgaggcagtccgccaaggaaaacatggagaaagagaggttcaaggccgtcattggcctgtacctcaccgtcgtctacagagtggtcaaaaacctggtggacgtcaatagcaggtacatcatggccttccatagcctggagagagattcccagctgtacaacgtgagcgtcgataatgattacctggccctcaccgacaccctggtcaaggagggcgacaacagcaggtccaggtacctggccggaaataaaaggctgagggattgcgtgaagcaagacatcgacaatgccaaaaagtggttcgtctccgacaagtacaactccattacaaagtacgcgaacaacgtggccgccctgaccgccgtgagaaactgcgccgagttcatcggcgacattaccaagatcgactcctacttcgccctctaccactacctcattcagagacagctggctaagggcctcgatcatgagaggtccggattcgacaggaattacccccagtacgcccctctgttcaaatggcacacctacgtgaaggatgtcgtcaaggccctgaacgcccccttcggatacaatatccctaggttcaagaatctgagcatcgacgccctctttgataggaatgaaatcaagaagaacgatggcgagaagaagtccgacgactga

SEQ ID NO: 124 - DNA, 2757 bp, Artificial Sequence
  Ruminococcus bicirculans nCas1 sequence
atggcaaaaaagaataaaatgaagcctagagagctgcgtgaggctcagaaaaaagccagacagctcaaagcggctgagataaataataacgctgttcctgcaatcgctgccatgcctgctgcagaggctgctgcacctgcggcagagaagaaaaaatcctccgtaaaggcggcaggaatgaagtctattcttgtcagtgaaaataaaatgtacataacctctttcggcaagggcaattctgcggtgcttgaatatgaggtggataataatgactacaacaaaactcagctttcctcaaaggacaacagtaatatcgagctctgtgatgtaggcaaagtaaacatcactttttcgagcagacgtggctttgagagcggtgtggagataaacacttcaaaccctactcacagaagcggtgaaagctcgtctgtaagaggggatatgctggggcttaaatcggagcttgaaaagcgctttttcggcaagaattttgatgataatatacatatccagcttatttacaacattctggatatcgaaaagatacttgcagtgtatgtgacgaatatcgtttatgcactgaacaatatgcttggggaaggcgatgagagcaattacgatttcatggggtatctttccacatttaacacttataaagtttttactaatcctaatggcagcactttatccgacgataagaaagagaatatcagaaaaagtcttagcaaattcaatgccctgctgaaaactaagcgtcttggctatttcggccttgaagagccaaagacaaaggatacaagagcttcggaagcatacaaaaagcgtgtttatcatatgcttgcaattgtggggcagataagacagtgtgtttttcatgataaatcgggtgcaaaaagatttgacctttacagttttattaacaatattgatcccgaatacagagaaacccttgactatcttgtagatgagagatttgattctataaataagggctttatccagggcaacaaggtcaatatcagcttgcttattgatatgatgaaaggctatgaggctgatgatatcatacgcctttattacgatttcattgtgcttaaatctcagaaaaatctcggtttttctatcaaaaagcttcgtgagaaaatgctggacgaatacggcttcagatttaaggacaagcaatatgactctgtgcgctcaaagatgtacaagcttatggattttctgcttttctgcaactactacagaaatgacattgccgcaggcgaatctcttgtgcgcaaactgcgtttttcaatgaccgatgatgaaaaagaggggatatatgctgatgaagcggcaaagctttggggcaaattcaggaatgattttgaaaatatcgccgaccacatgaacggtgacgttatcaaggagcttggcaaggctgacatggattttgatgagaaaattcttgacagcgaaaagaagaatgcgtctgaccttttgtatttctccaaaatgatatatatgctcacatattttcttgacggcaaggagataaacgaccttcttacaacgcttatcagcaagtttgataacatcaaggagtttttgaagataatgaaaagctctgctgttgatgttgagtgtgaacttacggcgggctacaagctgttcaatgacagccagaggataaccaacgagctttttatcgtaaagaacattgcttccatgagaaagcctgcggcttcggcgaagcttacgatgttccgtgacgcactgactatactcggtatagacgacaagatcacggacgataggataagcgagattctaaaacttaaagaaaaaggcaagggcatacatggcctgagaaatttcataacaaacaatgttatcgagtcctctcggtttgtataccttatcaagtatgcgaacgctcagaagataagagaagtggctaagaatgagaaagttgtcatgtttgttcttgggggtatccctgacacgcagatagagcgttattacaagagttgtgtggaatttcctgacatgaacagttctttgggagtaaagcgcagtgagcttgcgagaatgataaagaacatcagctttgatgatttcaaaaatgtgaaacagcaggcaaagggcagagaaaacgtggctaaggagagggcaaaggctgttatcgggctttatcttacggtcatgtatctgctggtgaaaaatcttgtgaatgtcaatgcaaggtatgttattgcgatacactgccttgaacgtgattttgggctgtataaggagataattcctgagttggcttcaaagaacttgaaaaatgactacaggatactttcacagacgctttgtgaactttgtgataagtcgccgaatttgttcttgaaaaagaacgagcggctgcgcaagtgcgttgaagttgatatcaataatgcagacagcagcatgacaagaaaataccgcaactgtattgctcatcttactgtagttcgtgaactgaaagaatacataggagatatttgtacagtggattcttacttctccatttatcattatgttatgcagcgctgtatcacgaaaagggaaaatgacacaaagcaagaagagaaaataaagtatgaggacgatcttttaaaaaatcacggctatacgaaagactttgtaaaggctctcaactcgccgtttggatacaacattccgaggtttaaaaatctttcaattgagcagttgtttgacagaaatgaatatcttactgaaaagtag

SEQ ID NO: 125 - DNA, 2865 bp, Artificial Sequence
  Eubacterium siraeum nCas1 sequence
atgggtaagaaaatacacgcacgagatctcagagaacaaagaaagaccgatagaacggaaaaatttgcagatcagaacaaaaaacgtgaagcagagagggcagttccgaaaaaagacgcagccgtttctgtaaaatcagtttcttctgtttcatcaaaaaaagacaatgtaacaaaatctatggctaaagccgcaggcgtgaagtcggtttttgctgtaggaaatactgtttatatgacttcattcggcagaggaaacgatgctgtacttgagcagaaaatagtcgatacatcgcacgaaccgctgaatattgacgatcctgcatatcagttgaacgttgtcacaatgaacggttattcggttaccggtcacagaggtgaaacggtatctgccgtaacggataatccgctgcgccgttttaacggaagaaagaaagatgaaccggaacagtctgtgcctacggatatgctgtgcctgaaaccgactcttgaaaagaaattcttcggcaaagaattcgatgataatatacatatccagcttatttacaatattcttgacattgaaaaaatactggcggtttattcgaccaacgctatttacgcattgaataatatgagtgctgacgaaaatatcgaaaacagcgatttcttcatgaaacgtaccaccgatgaaacctttgacgattttgaaaagaaaaaggagagtacaaacagtcgagagaaagccgattttgacgcatttgaaaaattcatcggcaattacaggctggcttattttgccgatgcattttatgtaaataaaaagaatcccaaaggtaaagcaaaaaatgttctgcgtgaggataaagaactttactccgtgctcactctgatcggtaaactgcgtcattggtgtgttcacagtgaggagggcagagcagaattctggctgtataagctcgatgaacttaaagatgatttcaaaaatgtactcgacgttgtttataaccgtcctgttgaagaaataaacaaccgctttatagaaaacaataaggtaaacatacagatactgggctcggtatacaagaacaccgatattgccgaacttgtaaggtcatattacgaatttcttatcacaaagaagtataaaaatatgggcttttcaataaagaagctccgtgagagtatgctcgaaggtaaaggttacgccgataaagaatatgattctgtaaggaataagctgtatcagatgacggatttcatcttatacacaggatatatcaacgaagacagcgatagagccgacgatcttgtgaacactttgagaagttcgctcaaagaggatgataagacaaccgtatattgcaaggaagcggattatctgtggaaaaaataccgtgaatccataagagaggttgccgatgcgcttgatggcgataacattaaaaagctgagcaaatcgaatattgaaattcaggaagacaagctgagaaaatgttttatcagctatgccgacagcgtatcggaatttaccaagcttatttatctgctgacaagatttttaagcggtaaggagatcaacgatcttgtcacaacgctgataaacaagtttgacaatatcagaagcttccttgaaataatggacgagcttgggcttgacaggaccttcaccgccgagtacagcttctttgaaggcagtacaaagtatcttgccgagcttgtcgagcttaacagctttgtgaaatcgtgttcgtttgatataaacgcaaaaagaacaatgtatcgcgatgcgctggatattctcggcattgaatcggataagaccgaagaagatattgagaagatgatcgataatatccttcagatcgacgcaaacggtgataaaaagctcaagaaaaacaacggtctgagaaatttcattgcaagtaacgttatagattcaaaccgattcaagtaccttgtgcggtacggaaatccaaagaagattcgtgaaacggcaaaatgcaagcccgctgtaaggtttgtgctgaatgagatcccggacgcacagatcgaaagatattatgaggcttgttgcccaaaaaatacagctttatgctctgcaaataagagacgtgagaaactggctgatatgatagctgaaataaagtttgagaatttttcggatgccggcaattatcagaaagcaaatgtcacatcaagaacgtctgaagctgaaatcaagcggaagaatcaggctataatccgtctttatcttaccgttatgtacattatgctgaagaaccttgtaaatgtgaacgccagatacgttatcgctttccattgcgttgaaagggatacgaagctgtatgcggaaagcggtctggaagtcggtaatatagaaaaaaacaagacaaatcttactatggctgtaatgggagtcaagctcgaaaacggaatcataaaaacggaatttgacaagagctttgcagaaaatgccgcaaacagatatctcaggaatgcacgctggtacaagctgatactggataatttaaagaagtcggaaagagcggttgtcaatgagttcagaaatactgtctgccatctgaatgcgataaggaatatcaatatcaatatcaaggaaataaaagaggtcgagaactactttgctctgtaccactacctcattcagaaacatctcgaaaatcgttttgccgataaaaaagtagaaagagacaccggcgattttataagcaagctcgaagaacacaagacttactgcaaggactttgtaaaagcatattgtacgcctttcggatataaccttgtgagatataaaaaccttacgatagacgggctgtttgataagaattaccccggaaaagacgattctgatgaacagaaataa

SEQ ID NO: 126 - DNA, 2799 bp, Artificial Sequence
  Ruminococcus flavefaciens FD1 nCas1 sequence
atgaaaaagaaaatgtctctccgtgaaaagcgtgaagccgagaaacaggctaaaaaagctgcatattcagcagcttcaaaaaatacagattctaagcctgcggaaaagaaagcagaaactccaaagcctgcggagattatttccgataattccagaaataagaccgctgtaaaggcggctggtctgaaatcaacaattatcagcggcgataagctgtatatgacatctttcggcaagggtaacgctgctgttattgagcagaaaatagatatcaatgattattctttttcagctatgaaagatactccgtcgcttgaagttgataaagcagaatcaaaagagatctctttttcaagtcaccatccttttgtaaagaatgataagctgacaacatataaccctttatacggcggcaaggataaccccgaaaagcctgtcggcagggatatgctcggcttaaaagataagcttgaagaacgctatttcggatgtacattcaatgataatcttcacatccagattatctataacatacttgacatcgagaagattttagctgttcattctgcaaatatcacaactgcgcttgaccacatggttgatgaagacgatgaaaaatatcttaacagcgattatatcggctacatgaataccataaatacatatgacgtgtttatggatccttcaaagaattcttcattaagccctaaagatagaaagaatattgacaacagccgtgcaaaatttgagaaactgctttcaactaagcgccttggctattttggatttgactatgatgcaaacggtaaggacaagaaaaagaacgaggaaataaaaaagcgtttatatcatctcacagcttttgcaggtcagctccgtcagtggagttttcatagtgctggcaattatccgagaacatggctttacaagctcgattcactggataaggaatatcttgatactcttgaccattacttcgataaacgttttaacgatataaacgatgatttcgtaactaagaatgctaccaatctctatattctgaaagaagtatttcccgaagcaaacttcaaggatattgccgatctttattacgatttcatagttataaagtcgcacaaaaatatgggattctccataaaaaagctgagggagaagatgcttgaatgtgatggtgcagacaggataaaagaacaggatatggactctgttcgctcaaagctgtataagctcatagacttttgcattttcaagtattatcacgaatttcctgaacttagtgaaaagaatgtggatatactcagagcggctgtatccgatacaaaaaaagataacctttattctgatgaggctgcacgtttatggagcatatttaaagaaaaattcctcggcttctgtgataagatagttgtatgggtaacaggagagcatgagaaagatatcacatccgttattgataaggatgcttacaggaacaggagcaatgtttcatatttctcaaagctgatgtatgcaatgtgctttttccttgacggaaaagagataaatgaccttctcactactcttatcaacaaattcgataatatcgctaaccagataaaaacagccaaagaacttggcattaatactgcttttgtaaagaattacgatttcttcaatcacagcgagaaatatgtcgatgaactgaacatcgtcaagaatattgcaagaatgaagaagccttcaagtaatgccaaaaaagctatgtatcatgatgcgcttactattctcggaatacctgaggatatggatgaaaaagctcttgatgaggaactggatttaattcttgaaaaaaagacagacccagtaactggcaagccactgaaaggtaagaatcctttacgtaattttatcgcaaacaatgtgatagagaattcaagattcatatatcttatcaagttctgcaatcctgagaatgtacgtaaaatcgtgaataatacaaaggtcactgagtttgtgttaaagcgtattcccgatgctcagatcgaacgctattataagtcgtgtacagattctgaaatgaatccgcctactgaaaagaagatcaccgaacttgctggtaagttaaaggatatgaactttggcaacttccgaaatgtgagacagtctgctaaagagaatatggagaaggagcgcttcaaagctgttatagggctttatctcacggtagtatatcgtgttgtcaagaatcttgttgatgtaaactcacgatatatcatggcttttcattcgcttgaacgtgattcacaactgtataacgtatctgttgataatgattatcttgcacttaccgatactcttgttaaggagggagataattccagaagcagatatcttgcaggcaacaagcgtctgagagattgtgtgaagcaggatatcgataatgcaaaaaagtggtttgttagtgataagtacaatagcataaccaagtacaggaataacgttgcccatcttaccgctgtacgtaactgcgctgaattcatcggagatataacgaagatagactcctattttgcattgtatcattatctcattcagagacagcttgcgaaaggtcttgaccatgagcgaagtggctttgacagaaactatccacagtatgcaccgctgtttaagtggcatacgtatgtaaaggatgttgtcaaggctctgaatgctccatttggctacaatatccctcgtttcaagaatctcagcatagatgcactttttgaccgcaacgaaataaagaagaatgacggcgagaaaaaatccgatgat

SEQ ID NO: 127 - DNA, 2835 bp, Artificial Sequence
  Ruminococcus albus nCas1 sequence
atggcaaaaaaatcgaaaggtatgagccttagagaaaaacgtgaacttgaaaagcagaaaaggatacaaaaggcagctgtgaattcagttaatgatacacctgaaaaaacagaagaagcaaatgtcgtatctgtaaatgtcaggacatcggctgagaataagcatagtaaaaaatctgctgccaaagctttgggactgaaatccgggctggttatcggtgatgagctgtaccttacttcattcggcagaggtaacgaagcaaagcttgaaaagaagatatccggtgacactgtcgaaaaacttggcattggtgcttttgaagtcgccgaacgtgacgaatcaacgcttaccctcgaaagtggcaggataaaggacaagaccgccagacccaaagaccccagacatataaccgtcgatacacaaggtaaattcaaggaagatatgcttgggatacgcagtgtactggagaaaaagatatttggcaaaacatttgatgataatatccatgttcagcttgcgtacaatatcctggatgtcgaaaagataatggcacagtatgtcagcgatatcgtatatatgctgcataatactgataaaacagaaagaaacgataatcttatggggtatatgagcatcaggaatacctataagacattttgtgatacgtcaaatcttcccgatgatacaaaacaaaaagttgaaaatcagaagagagagtttgacaagatcataaaaagcggcagacttgggtatttcggcgaagcttttatggtaaacagcggcaatagtaccaagcttagacccgagaaagagatatatcatatctttgcgcttatggcgagcctgaggcagagttactttcacggatatgtaaaagataccgattatcagggaaccacatgggcatatactcttgaggacaagctgaaaggtccgagccatgagttcagggaaaccattgataagatatttgatgagggattcagcaagatcagcaaggactttggcaagatgaacaaggtcaaccttcagatacttgaacagatgattggtgaactgtatggcagtatagaacgacaaaacctcacttgcgattactatgacttcattcaactgaaaaagcataagtatcttggattttctataaagcgtcttagagagaccatgcttgaaacaacaccggctgaatgttataaagctgaatgctataacagcgagcgtcaaaagctgtataagctgatagatttcctgatatatgatctttactataaccgtaagcctgcacgcatcgaagaaatcgtggacaagctgagggaatctgtgaacgacgaagagaaagaatccatatattcagttgaggcgaagtatgtctatgaatcacttagcaaagttctggataaatcgctgaaaaacagtgtgtctggtgaaacgataaaggatctccaaaagagatatgatgacgaaacagcaaacaggatctgggatatctcacagcacagtataagtggaaatgtcaactgtttctgcaagctaatttatattatgaccctgatgcttgacggcaaggagataaatgatctgctgacaacgctggtaaacaagttcgataacatagcatcatttatagatgttatggacgaacttggcttggagcatagttttacagataactataaaatgtttgccgacagcaaggctatatgccttgatctgcagttcataaacagttttgcacgtatgtcaaagatcgatgatgagaagtcaaaaagacagcttttccgtgatgcgcttgtcatactggatatcggtaataaagatgagacttggataaataattatctggattctgatattttcaaactggacaaagaaggtaacaagttaaagggcgcaaggcatgatttcaggaactttatagccaataatgttataaagtcatcacgtttcaaatacctagtaaaatacagcagtgccgatggtatgataaagctgaaaacgaatgaaaagctgataggctttgttctggataagcttccagaaacgcagatagaccgctactatgaatcatgcggacttgacaatgcggtagtagataagaaagtcaggatagaaaagctatcggggcttatcagagatatgaagttcgatgatttcagcggtgtcaaaacctcaaacaaagcaggagataatgacaaacaggataaggcgaaatatcaggcgataataagcctgtacctcatggtgctgtatcagatagtcaagaacatgatatatgtcaactcacgttatgttatcgctttccattgtcttgaacgtgactttggtatgtatggaaaagattttggaaagtattatcaaggctgccgaaaacttacagatcattttattgaagaaaagtacatgaaagagggtaaacttggctgcaataaaaaagtcggcagatatctgaaaaataatatttcctgctgcactgatggactgataaatacctaccgtaatcaggttgatcactttgcagtggtaaggaagataggcaactatgcggcatatatcaagagtatcggttcgtggtttgaactttatcactatgtaatacagaggatagtttttgacgaatacagatttgcacttaacaacactgaaagcaactataagaacagcatcatcaagcaccatacctactgtaaggatatggtcaaggcactgaacacacctttcggttatgacctgccgagatacaagaatctttctatcggtgatctgtttgatcgcaataattatctgaataaaacaaaagagtcaatagatgcaaatagctctattgacagtcagtga

SEQ ID NO: 128 - DNA, 2904 bp, Artificial Sequence
  Ruminococcus flavefaciens XPD nCas1 sequence
atgatcgaaaagaagaagtcatttgcaaagggcatgggagtaaaatcaacacttgtatccggttcaaaggtatacatgacgacgttcgcagaaggaagcgatgccagacttgaaaagatcgttgaaggcgattctatcagatctgtcaacgaaggagaagcgttctcagctgaaatggctgataagaatgcaggctacaagatcggtaacgcaaagttcagccacccaaagggctatgctgtagttgcaaacaaccccttatacaccggaccggtacagcaggatatgctcggtctgaaggaaacgcttgaaaagagatattttggagagtctgccgacggaaatgataatatctgtattcaggtcatccataatatcctcgatatcgaaaagatcctcgctgaatatataaccaatgctgcttatgcggtaaacaatatttccggtcttgataaggatatcatcggttttggtaagttcagtacggtctatacttatgatgagttcaaggatcctgaacatcacagagcagctttcaacaataacgataagttaattaatgccatcaaggcacagtatgatgaatttgacaatttccttgataatcctcgtctcggctactttggacaggcttttttcagtaaggaaggcagaaattacattatcaattacggcaacgagtgttatgatattcttgctttactcagcggattgcgtcactgggtagtacataataatgaggaagaatcaaggatttcccgtacatggctttataatctcgacaagaatcttgacaacgaatatatctctactctcaattatctgtatgatagaattacaaacgaattaacaaattccttctcaaagaatagtgcagccaacgtaaactatatcgctgaaacccttggtattaatcctgctgaatttgcagagcagtatttcagattcagtatcatgaaggaacagaagaatctcggtttcaatattactaagctgagagaagtaatgcttgacagaaaggatatgtctgagatccgtaaaaatcataaggtctttgattcaatccgtactaaggtctatactatgatggatttcgttatctacagatattacattgaagaggatgcaaaggttgctgctgccaacaagtctctgccggataacgaaaaaagcctcagtgaaaaggatatctttgttataaatctcagaggaagctttaacgatgatcagaaggatgccctttattatgatgaggccaatcgtatttggagaaagctcgaaaacattatgcacaatatcaaggaattcagaggcaataagacacgtgaatacaagaagaaggatgctccaagactccccagaattcttcctgccggaagggatgtttccgcgttctcaaagttgatgtacgctcttaccatgttccttgatggtaaggagatcaatgatcttctcaccacgctcatcaataagttcgataacatccagagtttcctcaaggtaatgcctcttatcggagtgaatgcaaagtttgttgaggaatatgccttcttcaaggacagcgcaaagattgctgacgaactcaggctgattaagagctttgccagaatgggagaacctatcgcagatgcaagacgtgctatgtatatcgatgctatcaggattctcggaacaaacctcagctatgatgagcttaaggcccttgccgatactttttcgcttgatgaaaacggcaacaagcttaagaagggcaagcacggcatgagaaacttcatcattaataatgtaatcagtaacaagcgcttccattatctcattcgttacggtgatcctgcacatctccatgagatcgccaagaatgaagctgttgtaaagttcgtcctcggcaggatagctgatatccagaagaagcagggacagaacggaaagaatcagatcgacaggtactatgagacctgtatcggcaaggacaagggcaagtctgtctccgaaaaggttgatgccctcacaaagattatcaccggtatgaactacgatcagttcgataagaagagaagcgttattgaggatactggaagagaaaacgctgagagagaaaagttcaagaagatcatcagcctctatcttactgtcatttatcacatccttaagaatattgttaatatcaatgcgcgttacgttatcggcttccattgcgttgagcgtgatgcacagctctataaggaaaagggctatgatatcaacctcaagaagctcgaagaaaaggggttttcatcagtcacaaagctgtgtgcaggtattgatgagactgctcctgacaagcgtaaggatgttgaaaaggaaatggctgagcgtgcaaaggaatctatcgatagccttgaatctgcaaatcctaagctttacgcaaactatatcaagtattctgacgagaagaaggctgaggaatttactagacagatcaaccgtgagaaggcaaagaccgctctgaatgcatatctcagaaatactaagtggaatgtgataatcagggaagatcttcttagaatcgataataagacatgtacgctctttagaaataaggccgttcatcttgaagttgcaagatatgttcatgcatatatcaacgatattgccgaagtaaacagctatttccagctttatcattacatcatgcagagaatcatcatgaacgaaagatatgaaaagtcttctggaaaggtaagcgaatacttcgatgctgtgaacgatgaaaagaagtacaacgacaggcttctgaagctgttgtgcgttccatttggttactgcatcccgagattcaagaatctctccattgaagctttgttcgacaggaacgaagcagctaagtttgacaaggaaaagaagaaagtatcaggtaattcatag

SEQ ID NO: 129 - DNA, 36 bp, Artificial Sequence
  Consensus DR
gaactacacccgtgcaaaaatgcaggggtctaaaac

SEQ ID NO: 130 - DNA, 36 bp, Artificial Sequence
  Consensus DR
ctactacactggtgcaaatttgcactagtctaaaac

SEQ ID NO: 131 - DNA, 36 bp, Artificial Sequence
  Consensus DR
caaguaaaccccuaccaacuggucgggguuugaaac

SEQ ID NO: 132 - DNA, 36 bp, Artificial Sequence
  Consensus DR
cuacuacacuggugcgaauuugcacuagucuaaaac

SEQ ID NO: 133 - DNA, 36 bp, Artificial Sequence
  Consensus DR
gaacuauaguagugugaauuuacacuacucuaaaac

SEQ ID NO: 134 - DNA, 36 bp, Artificial Sequence
  Consensus DR
cuacuauacuagugugauuuuacacuagucuaaaac

SEQ ID NO: 135 - DNA, 36 bp, Artificial Sequence
  Consensus DR
gaccaacaccucugcaaaacugcaggggucuaaaac

SEQ ID NO: 136 - DNA, 36 bp, Artificial Sequence
  Consensus DR
gcacuacaccccccugaaacaugaggggucuaaaac

SEQ ID NO: 137 - DNA, 36 bp, Artificial Sequence
  Consensus DR
gcactacacccccctgaaacatgaggggtctaaaac

SEQ ID NO: 138 - protein, 966 aa, Artificial Sequence
  50% consensus sequence for 7 full-length nCas1 orthologues
  misc_feature (2)..(4): Xaa can be any naturally occurring amino acid
  misc_feature (13)..(13): Xaa can be any naturally occurring amino acid
  misc_feature (22)..(23): Xaa can be any naturally occurring amino acid
  misc_feature (25)..(25): Xaa can be any naturally occurring amino acid
  misc_feature (32)..(33): Xaa can be any naturally occurring amino acid
  misc_feature (39)..(40): Xaa can be any naturally occurring amino acid
  misc_feature (43)..(44): Xaa can be any naturally occurring amino acid
  misc_feature (46)..(56): Xaa can be any naturally occurring amino acid
  misc_feature (60)..(60): Xaa can be any naturally occurring amino acid
  misc_feature (69)..(70): Xaa can be any naturally occurring amino acid
  misc_feature (72)..(72): Xaa can be any naturally occurring amino acid
  misc_feature (74)..(76): Xaa can be any naturally occurring amino acid
  misc_feature (83)..(83): Xaa can be any naturally occurring amino acid
  misc_feature (86)..(86): Xaa can be any naturally occurring amino acid
  misc_feature (88)..(88): Xaa can be any naturally occurring amino acid
  misc_feature (94)..(95): Xaa can be any naturally occurring amino acid
  misc_feature (97)..(108): Xaa can be any naturally occurring amino acid
  misc_feature (110)..(135): Xaa can be any naturally occurring amino acid
  misc_feature (139)..(147): Xaa can be any naturally occurring amino acid
  misc_feature (149)..(150): Xaa can be any naturally occurring amino acid
  misc_feature (157)..(158): Xaa can be any naturally occurring amino acid
  misc_feature (162)..(162): Xaa can be any naturally occurring amino acid
  misc_feature (167)..(167): Xaa can be any naturally occurring amino acid
  misc_feature (191)..(192): Xaa can be any naturally occurring amino acid
  misc_feature (201)..(209): Xaa can be any naturally occurring amino acid
  misc_feature (211)..(211): Xaa can be any naturally occurring amino acid
  misc_feature (213)..(214): Xaa can be any naturally occurring amino acid
  misc_feature (216)..(217): Xaa can be any naturally occurring amino acid
  misc_feature (220)..(221): Xaa can be any naturally occurring amino acid
  misc_feature (225)..(225): Xaa can be any naturally occurring amino acid
  misc_feature (227)..(228): Xaa can be any naturally occurring amino acid
  misc_feature (230)..(242): Xaa can be any naturally occurring amino acid
  misc_feature (244)..(249): Xaa can be any naturally occurring amino acid
  misc_feature (251)..(251): Xaa can be any naturally occurring amino acid
  misc_feature (253)..(257): Xaa can be any naturally occurring amino acid
  misc_feature (264)..(264): Xaa can be any naturally occurring amino acid
  misc_feature (267)..(270): Xaa can be any naturally occurring amino acid
  misc_feature (273)..(280): Xaa can be any naturally occurring amino acid
  misc_feature (283)..(283): Xaa can be any naturally occurring amino acid
  misc_feature (285)..(285): Xaa can be any naturally occurring amino acid
  misc_feature (290)..(292): Xaa can be any naturally occurring amino acid
  misc_feature (296)..(298): Xaa can be any naturally occurring amino acid
  misc_feature (300)..(310): Xaa can be any naturally occurring amino acid
  misc_feature (314)..(314): Xaa can be any naturally occurring amino acid
  misc_feature (316)..(318): Xaa can be any naturally occurring amino acid
  misc_feature (320)..(321): Xaa can be any naturally occurring amino acid
  misc_feature (323)..(325): Xaa can be any naturally occurring amino acid
  misc_feature (329)..(331): Xaa can be any naturally occurring amino acid
  misc_feature (333)..(337): Xaa can be any naturally occurring amino acid
  misc_feature (340)..(341): Xaa can be any naturally occurring amino acid
  misc_feature (343)..(345): Xaa can be any naturally occurring amino acid
  MISC_FEATURE (350)..(350): Xaa can be Ile or Leu
  misc_feature (351)..(352): Xaa can be any naturally occurring amino acid
  misc_feature (354)..(357): Xaa can be any naturally occurring amino acid
  misc_feature (359)..(364): Xaa can be any naturally occurring amino acid
  MISC_FEATURE (365)..(365): Xaa can be Ile or Leu
  misc_feature (366)..(368): Xaa can be any naturally occurring amino acid
  misc_feature (373)..(375): Xaa can be any naturally occurring amino acid
  misc_feature (377)..(378): Xaa can be any naturally occurring amino acid
  misc_feature (391)..(391): Xaa can be any naturally occurring amino acid
  misc_feature (394)..(397): Xaa can be any naturally occurring amino acid
  misc_feature (399)..(400): Xaa can be any naturally occurring amino acid
  MISC_FEATURE (401)..(401): Xaa can be Ile or Leu
  misc_feature (402)..(404): Xaa can be any naturally occurring amino acid
  misc_feature (411)..(411): Xaa can be any naturally occurring amino acid
  misc_feature (415)..(415): Xaa can be any naturally occurring amino acid
  misc_feature (417)..(417): Xaa can be any naturally occurring amino acid
  MISC_FEATURE (420)..(420): Xaa can be Ile or Leu
  misc_feature (423)..(424): Xaa can be any naturally occurring amino acid
  misc_feature (426)..(427): Xaa can be any naturally occurring amino acid
  misc_feature (429)..(433): Xaa can be any naturally occurring amino acid
  misc_feature (435)..(436): Xaa can be any naturally occurring amino acid
  misc_feature (438)..(439): Xaa can be any naturally occurring amino acid
  misc_feature (442)..(442): Xaa can be any naturally occurring amino acid
  misc_feature (444)..(445): Xaa can be any naturally occurring amino acid
  misc_feature (447)..(447): Xaa can be any naturally occurring amino acid
  misc_feature (450)..(452): Xaa can be any naturally occurring amino acid
  misc_feature (454)..(455): Xaa can be any naturally occurring amino acid
  misc_feature (458)..(459): Xaa can be any naturally occurring amino acid
  misc_feature (462)..(477): Xaa can be any naturally occurring amino acid
  misc_feature (479)..(480): Xaa can be any naturally occurring amino acid
  MISC_FEATURE (481)..(481): Xaa can be Ile or Leu
  misc_feature (483)..(485): Xaa can be any naturally occurring amino acid
  misc_feature (487)..(487): Xaa can be any naturally occurring amino acid
  misc_feature (489)..(489): Xaa can be any naturally occurring amino acid
  misc_feature (491)..(506): Xaa can be any naturally occurring amino acid
  misc_feature (509)..(510): Xaa can be any naturally occurring amino acid
  misc_feature (517)..(517): Xaa can be any naturally occurring amino acid
  misc_feature (520)..(520): Xaa can be any naturally occurring amino acid
  misc_feature (542)..(542): Xaa can be any naturally occurring amino acid
  misc_feature (546)..(546): Xaa can be any naturally occurring amino acid
  misc_feature (549)..(549): Xaa can be any naturally occurring amino acid
  misc_feature (554)..(556): Xaa can be any naturally occurring amino acid
  misc_feature (558)..(560): Xaa can be any naturally occurring amino acid
  misc_feature (562)..(563): Xaa can be any naturally occurring amino acid
  misc_feature (565)..(566): Xaa can be any naturally occurring amino acid
  misc_feature (568)..(569): Xaa can be any naturally occurring amino acid
  misc_feature (571)..(572): Xaa can be any naturally occurring amino acid
  misc_feature (575)..(577): Xaa can be any naturally occurring amino acid
  misc_feature (580)..(580): Xaa can be any naturally occurring amino acid
  misc_feature (584)..(584): Xaa can be any naturally occurring amino acid
  misc_feature (587)..(589): Xaa can be any naturally occurring amino acid
  misc_feature (593)..(593): Xaa can be any naturally occurring amino acid
  misc_feature (600)..(600): Xaa can be any naturally occurring amino acid
  misc_feature (605)..(612): Xaa can be any naturally occurring amino acid
  misc_feature (614)..(616): Xaa can be any naturally occurring amino acid
  misc_feature (618)..(623): Xaa can be any naturally occurring amino acid
  MISC_FEATURE (624)..(624): Xaa can be Ile or Leu
  misc_feature (626)..(629): Xaa can be any naturally occurring amino acid
  misc_feature (631)..(632): Xaa can be any naturally occurring amino acid
  misc_feature (634)..(636): Xaa can be any naturally occurring amino acid
  misc_feature (648)..(648): Xaa can be any naturally occurring amino acid
  misc_feature (650)..(650): Xaa can be any naturally occurring amino acid
  misc_feature (653)..(653): Xaa can be any naturally occurring amino acid
  misc_feature (656)..(656): Xaa can be any naturally occurring amino acid
  misc_feature (659)..(659): Xaa can be any naturally occurring amino acid
  misc_feature (662)..(664): Xaa can be any naturally occurring amino acid
  misc_feature (666)..(666): Xaa can be any naturally occurring amino acid
  MISC_FEATURE (667)..(667): Xaa can be Ile or Leu
  misc_feature (669)..(669): Xaa can be any naturally occurring amino acid
  misc_feature (673)..(675): Xaa can be any naturally occurring amino acid
  misc_feature (679)..(680): Xaa can be any naturally occurring amino acid
  misc_feature (684)..(684): Xaa can be any naturally occurring amino acid
  misc_feature (694)..(696): Xaa can be any naturally occurring amino acid
  misc_feature (698)..(706): Xaa can be any naturally occurring amino acid
  misc_feature (708)..(709): Xaa can be any naturally occurring amino acid
  misc_feature (711)..(713): Xaa can be any naturally occurring amino acid
  misc_feature (715)..(718): Xaa can be any naturally occurring amino acid
  misc_feature (720)..(720): Xaa can be any naturally occurring amino acid
  misc_feature (723)..(723): Xaa can be any naturally occurring amino acid
  misc_feature (726)..(726): Xaa can be any naturally occurring amino acid
  misc_feature (728)..(733): Xaa can be any naturally occurring amino acid
  misc_feature (735)..(738): Xaa can be any naturally occurring amino acid
  misc_feature (742)..(742): Xaa can be any naturally occurring amino acid
  misc_feature (745)..(745): Xaa can be any naturally occurring amino acid
  misc_feature (753)..(753): Xaa can be any naturally occurring amino acid
  misc_feature (755)..(756): Xaa can be any naturally occurring amino acid
  misc_feature (778)..(779): Xaa can be any naturally occurring amino acid
  misc_feature (782)..(797): Xaa can be any naturally occurring amino acid
  misc_feature (800)..(812): Xaa can be any naturally occurring amino acid
  misc_feature (816)..(852): Xaa can be any naturally occurring amino acid
  misc_feature (856)..(856): Xaa can be any naturally occurring amino acid
  misc_feature (858)..(858): Xaa can be any naturally occurring amino acid
  misc_feature (861)..(861): Xaa can be any naturally occurring amino acid
  misc_feature (863)..(863): Xaa can be any naturally occurring amino acid
  misc_feature (865)..(865): Xaa can be any naturally occurring amino acid
  MISC_FEATURE (866)..(866): Xaa can be Ile or Leu
  misc_feature (867)..(868): Xaa can be any naturally occurring amino acid
  misc_feature (871)..(871): Xaa can be any naturally occurring amino acid
  misc_feature (874)..(875): Xaa can be any naturally occurring amino acid
  misc_feature (877)..(877): Xaa can be any naturally occurring amino acid
  misc_feature (886)..(887): Xaa can be any naturally occurring amino acid
  misc_feature (890)..(890): Xaa can be any naturally occurring amino acid
  misc_feature (892)..(897): Xaa can be any naturally occurring amino acid
  misc_feature (899)..(912): Xaa can be any naturally occurring amino acid
  misc_feature (914)..(914): Xaa can be any naturally occurring amino acid
  misc_feature (917)..(917): Xaa can be any naturally occurring amino acid
  misc_feature (920)..(920): Xaa can be any naturally occurring amino acid
  misc_feature (926)..(926): Xaa can be any naturally occurring amino acid
  MISC_FEATURE (932)..(932): Xaa can be Ile or Leu
  misc_feature (941)..(942): Xaa can be any naturally occurring amino acid
  misc_feature (949)..(954): Xaa can be any naturally occurring amino acid
  misc_feature (956)..(957): Xaa can be any naturally occurring amino acid
  misc_feature (959)..(963): Xaa can be any naturally occurring amino acid
MXXXKKKMSLREXREAEKQARXXKXAAASKNXXAVPAKXXAAXXPXXXXXXXXXXXKKSXAKAAGLKSXXVXGXXXYMTSFGXGNXAXLEKKIXXBXXXXXXXXXXXXEXXXXXXXXXXXXXXXXXXXXXXXXXXNPLXXXXXXXXXVXXDMLGLKXXLEKXYFGKXFDDNIHIQLIYNILDIEKILAVYXXNIVYALNNXXXXXXXXXNXDXXGXXSTXXTYDXFXXPXXXXXXXXXXXXXIXXXXXXFXKXXXXXRLGYFGXAFXXXXKBXXXXXXXXKEXYXILALXXXLRQXXXHXXXXXXXXXXXWLYXLXXXLXXEXXXTLDXXXDXXXXXINXXFXXXNKVNXXXLXXXXGXXXXXXXXXXYYDFXXXKXXKNLGFSIKKLREXMLXXXXAXXXXXXZYDSVRXKLYXLXDFXIYXXYXXEXXXXXEXXVXXLRXSXXDXEKXXXYXXEAXXLWXXXXXXXXXXXXXXXXGXXXKXXXKXBXDXXXXXXXXXXXXXXXXBVXXFSKLIYXLTXFLDGKEINDLLTTLINKFDNIXSFLXVMXELGLXXXFXXXYXXFXXSXXIXXELXXXKNXARMXKPXXXAKRXMYRDALXILGIXXXXXXXXIXXXLXXXXXXXDXXXXKXXKXXXGLRNFIANNVIXSXRFXYLXRYXNPXXXRXXAXNEKXXXFVLXXIPDXQIERYYESCXXXBXXXXXXXXXIXXLXXXIXXXXFXBFXBVXQXXXXXXNXXXXKEKXKAXIGLYLTVXYXXVKNLVNVNARYVIAFHCLERDXXLYXXXXXXXXXXXXXXXXLTXXXXXXXXXXXXXYLKXXXXXXXXXXXXXXXXXXXXXXXXXXXXXXXXXXXXXYRNXVXHLXAXRXXXXYIXDIXXVXSYFALYHYXXQRXLXXXXXXKXXXXXXXXXXXXXXHXTYXKDXVKALNXPFGYNXPRYKNLSIXXLFDRNEXXXXXXEXXKXXXXXDSQ

SEQ ID NO: 139 - DNA, 2718 bp, Artificial Sequence
  Gut metagenome P1E0 nCas1 sequence
atggaacgtgaggtcaaaaagccccccaaaaaatccttggcaaaggcggcgggactgaagtccaccttcgtcatttcgccgcaggagaaggagctggccatgaccgccttcgggcggggcaacgacgcgctgctgcaaaagcgcatcgtggacggcgtggtgcgggatgtggccggagagaagcagcagtttcaggtgcagcggcaggacgagagccgtttccgactgcaaaacagccgccttgccgaccgcacggtaacggcggacgacccgctgcaccgcgcggagacgccccgccgccagccgctgggcgcaggtatggatcagctgcgccgcaaggcaatactggagcagaaatacttcggcaggacgtttgacgacaacatccacatccaactgatctacaacatattggacatccacaagatgctggctgtccccgccaaccacatcgtccacacgctgaatctgctgggcggatacggcgagacggactttgtggggatgctgcccgccgggctgccgtatgacaagctgagggtcgtgaaaaaaaagaacggcgacaccgtggacatcaaggcggatatcgccgcctatgccaagcggccgcagctggcctatctgggtgcggcgttctatgacgtgacccccggcaagagcaaaagggacgcggcgcggggcagagtcaagcgcgagcaggacgtgtatgccattctctcgctgatgagccttctgcggcagttctgcgcccacgacagtgtgcggatatggggacagaacaccaccgccgccctgtatcatttgcaggcgctgccgcaggacatgaaggatctgctggatgacggctggcgcagggcgctgggcggcgtcaacgaccatttcctcgacaccaacaaggtgaacctgctgaccctgttcgagtactacggcgccgagacgaagcaggcgcgggtggcgctgacgcaggacttctaccgcttcgtggtgctgaaggagcagaagaacatgggcttctccctgaggcgtctgcgggaggagctgctgaagctgccggacgccgcctacctcaccggtcaggagtacgactcggtgcggcagaagctgtatatgctgctggacttcctgctgtgccgcctctacgcgcaggagcgggccgaccgctgcgaggagctggtgtccgcgctgcgctgcgccttgtcggatgaggaaaaggacaccgtctatcaggcggaggccgccgcgctgtggcaggcgctgggcgacacgctgcgccggaagctgctgccgctgctgaaaggcaaaaagctgcaagacaaggacaagaagaagtcggatgagctggggctgtcccgtgacgtgctggatggtgtgctgttccgccccgcacagcagggcagccgcgccaacgccgactatttctgccggctgatgcacctgtccacatggttcatggacggcaaggagatcaacaccctgctgaccaccctcatcagcaagcttgagaatatcgacagcctgcggagcgtgctggagagcatgggactggcgtacagctttgtaccggcctacgccatgtttgaccacagccgctatatcgccggtcagctgcgggtggtcaacaacatcgcgcggatgcgtaagcctgccatcggcgccaagcgggagatgtaccgcgccgccgtggtgctgctgggcgtggacagcccggaggcagccgcggccatcaccgacgacctgctgcagatcgacccggaaacggggaaggtgcgcccccgcagcgacagcgcacgggacacgggtctgcggaacttcatcgccaacaacgtggtggaatcccgccgcttcacctacctgctgcgctacatgacgccggagcaggcgcgcgtgctggcgcagaacgaaaagctcatcgccttcgtgctgtccaccgtgcccgacacccagctggagcgctactgccgcacctgcgggcgggaggacatcaccggccgtccggcgcagatacgttacctgacggcgcagatcatgggcgtccggtatgagagcttcaccgatgtggagcagcgcgggagaggggataaccccaaaaaggagcggtacaaggctctcatcggcctgtacctgacggtgctgtatctggcggtgaagaatatggtcaactgcaacgcccgctacgtcatcgccttctactgccgtgaccgtgacacagcgctctatcagaaggaggtctgctggtacgatctggaggaggacaagaaaagcggcaagcagcggcaggtggaggactacaccgccctgacccgctattttgtgtcgcagggctatctgaaccgccatgcctgcggctatctgcgaagcaatatgaacggcatcagcaacagcctgctgaccgcctaccgcaacgcggtggatcacctgaacgcgatcccgccgctgggcagcctgtgccgggacatcggccgggtggacagctactttgccctgtaccactacgccgtgcagcagtatctgaacggcagatattacagaaagacgccccgcgagcaggagctgtttgccgccatggcgcagcataggacatggtgcagcgatctggtgaaggcactgaacaccccctttggctacaacctcgcccgctacaagaacctgtccattgacggtctgtttgaccgcgagggcgaccatgtggtgcgggaggacggcgaaaaaccggcggag

SEQ ID NO: 140 - DNA, 2835 bp, Artificial Sequence
  Anaerobic digester nCas1 sequence
aataacaaaagaaaaaccaaagctaaggcagctggactcaaatccgtttttttcgaccaaaagcaagctgttttgacgacttttgcaaaaggcaataattctcaaatcgaaaagaaggtcgtaaatagcgaggttaaggatttgcgacaaccacctgcttttgatctcgaacttaaagagaagactttttatatcagcggtaaaaacaacatcaatacctcaagagaaaacccattggcttccgcgtcgcttcctctaagcaagcgacaacgaattagagcagaaagaattaaacgggcgagagaggagaatcgcccctaccataacgtaaagagagtcggcgaagatgacttacgggcgaaagccgatttagagaagcactatttcggaaaagaatactctgacaatttaaaaattcaaataatctacaacattctcgatataaataagattatttccccctatattaatgatattgtttattctatgaataatcttgctcgtaacgacgagtatattgatggcaagattgatgttatcggcagtttaagctcgacgaccgattactcttcatttatgagtccaaataaggatttagaaaaagaaaaaaaattctcttttcatcgcgaaaactacaaaaaatttgtcgaagcctctaagccatatatgcgatattatggaaaagtttttattcgcgatgtcaaaaagagcaaactcagcaccggcaagggcgagaaaatcgaagtcatgtatcgctctgacgaggaaattttcacaatcttccaaatattaagttatgttcgtcaaagcatcatgcataatgatataggcaataagtcatcgattttagcaatcgaaaaatatcctgcccgctttgttgggttcttatcggacttgcttaaaacaaaaacaaatgatgtcaatagaatgttcatcgataataatagccagactaatttctgggtacttttttctatctttggtcttcaagatcatacgagcggcgcggacaaaatttgtcgtaatttttatgatttcgtcattaaagccgatagcaaaaacttaggtttttcacttaaaaaaatacgggaattaatgctcgatttgccaaatgccaatatgcttagagatcatcaatttgacactgttcgcagcaagttttacacactgcttgatttcatcatttaccagcactatttagaagaaaagtcgcgaatagacaatatggttgagaagttaagaatgactttaaaagaggaagaaaaggaagtgctttatgctgccgaggcaaaaatagtctggaacgccatcggggcgaaagtcataaacaagcttgttccgatgatgaatggcgacgcgctaaaagagattaaaaggaaaaacagagaccgcaaattgcctcaaagcgttatcgcaacggtccaagttaattcagacgctaacgtatttagtggcctgatatacttccttaccctctttttagacggcaaagaaattaatgaaatggtcagcaaccttattaccaaattcgaaaacattgatagtttactccatgttgatcgcgaaatttataaaagcgatgaaaaggatctcgatttagaaattgaaaaactcgcccttttctttaaaggtgtcgtgcgaccgaacgctaaaacggataccggcgccggagaaatatctaaatcattttcgatatttcaatccgccgaaagaattatcgaggagctgaagtttatcaaaaatgtgacgcggatggataatgaaattttcccatcagaaggagtgtttttagatgcggcaaatgtcttgggagttagaggcgacgacttcgatttttcaaacgaatttgtcggtgatgatttgcattctgacgccaataaaaaaattatcaataagatcaacggcaccaaagaagatcgcaatttgcgcaacttcataataaataatgttgtcaagtcgcggcgctttcaatatatcgcccgccacatgaacacacactatgttaaacaactcgccaacaacgaaactctcaaccgctttgtcttaaataaaatgggtgatgctaaaatcattaaccgctactacgaaagcatcagtggaaacactccaaatatcgaggttagaagccagatcgattatttggttaaacgtcttcggagtttcagttttgaagatctcaacgacgtaaaacaaaaagtgaggcccggcacaaatgaaagcatagaaaaggaaaagaaaaaagcgctagtgggtctttgcttaaccattcaatacttggtatataagaatctcgtcaatataaacgctcgttatacgactgctttctattgtcttgaacgggacagcaaacttaaaggctttggagttgatgtttggcgagattttgaaagctatacagccctgacaaatcactttattaaagagggctatcttcctgtccgcaaggcagaaattttacgagcgaatttaaaacatcttgattgcgaagatggatttaaatattatcgcaaccaagtcacacaccttaacgccatccgcgtagcatacaaatatattaacgaaattaaaagtgttcactcatatttcgcgctctatcattatattatgcaacgccacctatatgattctttgcaggcaaaggcaaaagattctagtggttttgttattgacgccttaaaaaagagttttgagcacaagatttactcgaaggatcttttgcacgttcttcattcgcccttcggttacaatacggcccgatacaaaaacttaagtatcgaggcattatttgacaaaaacgaaagccggcccgaggtgaatcctttatcgaccaacgat

SEQ ID NO: 141 - DNA, 2769 bp, Artificial Sequence
  Ruminococcus sp. CAG:57 nCas1 sequence
atggcaaaaaagaataaaatgaagcctagagagctgcgtgaggctcagaaaaaagccagacagctcaaagcggctgagataaataataacgctgctcctgcgatcgctgccatgcctgctgcagaggtcattgcacctgtggcagagaagaaaaaatcctccgtaaaggcggcaggaatgaagtctattcttgtcagcgaaaataaaatgtacataacctctttcggcaagggcaattctgctgtgcttgaatatgaggtggacaataatgactacaacaaaactcagctttcttcaaaggacaacagcaatatcgagcttggtgatgtaaacgaggtaaacatcactttttcaagcaagcatggctttgggagcggagtggagataaatacttcaaaccctactcacagaagcggtgaaagctcgcctgtaagaggggatatgctggggcttaaatcggagcttgaaaagcgctttttcggcaaaacttttgatgataatatacatatccagcttatttacaacattctggatatcgaaaagatacttgcggtgtatgtaacgaatatcgtttatgcgctgaacaatatgcttggtataaaggattctgaaagttatgatgattttatggggtatctttctgcaagaaatacttatgaagtttttactcaccctgacaaaagcaatctttccgataaggtaaagggtaatatcaagaaaagccttagcaagtttaatgacttgctgaaaactaagcgccttggctatttcggccttgaagagccaaagacaaaagacacaagagcttcggaagcatacaaaaagcgtgtttatcatatgcttgcaattgtggggcagataagacagtgtgtttttcatgataaatcgggtgcaaaaagatttgacctttacagttttattaacaatattgatcccgaatacagagatactcttgactatcttgttgaggagcgtttaaagtccataaacaaggactttatcgagggtaacaaggtcaatatcagcctgcttattgatatgatgaaaggctatgaggctgatgatatcatacgcctttattacgatttcattgtgcttaaatctcagaaaaatctcggcttttctatcaaaaagcttcgtgagaaaatgctggaggaatacggtttcagatttaaggacaagcaatatgactctgtgcgctcaaagatgtacaagcttatggatttcctgcttttctgcaactactacagaaatgacgttgccgcaggcgaagctcttgtgcgtaaactgcgtttttcaatgaccgatgatgaaaaagaggggatatatgctgatgaagcggcaaagctttggggcaaattcaggaatgattttgaaaatatcgccgaccacatgaacggtgacgttatcaaggagcttggcaaggctgacatggattttgatgagaaaattcttgacagtgaaaagaagaatgcgtctgaccttttgtatttctccaaaatgatatatatgctcacatattttcttgacggcaaggagataaacgatcttcttacaacgcttatcagcaagtttgataacatcaaggagtttttgaagataatgaaaagctctgctgttgatgttgagtgtgagcttacggcgggctacaagctgttcaatgacagccagaggataaccaacgagctttttatcgtaaagaacattgcttccatgagaaagcctgcggcttcagcgaagcttacgatgttccgtgacgcactgactatactcggtatagacgacaatatcacggacgataggataagcgagattctaaaacttaaagaaaaaggcaagggcatacatggtctgagaaattttataacaaacaatgttatcgagtcctctcggtttgtataccttatcaagtatgcgaacgctcagaagataagagaagtggctaaggatgagaaagttgtcatgtttgttcttgggggtatccctgacacgcagatagagcgttattacaagagttgtgtggagtttcctgacatgaatagttctttggaagcaaagcgcagtgagcttgcgagaatgataaagaacatcagctttgatgatttcaaaaatgtgaaacagcaggcaaagggcagagaaaacgtggctaaggagagggcaaaggctgttatcgggctttatcttacggtcatgtatctgctggtgaaaaatcttgtgaatgtcaatgcaaggtatgttattgcgatacactgccttgaacgtgattttgggctgtataaggagataattcctgagttggcttcaaagaacttgaaaaatgactacaggatactttcacagacgctttgtgaactttgtgatgatcgtaatgagtcgtcgaatttgttcttgaaaaagaacaagcggctgcgcaagtgcgttgaagttgatatcaataatgcagacagcagcatgacaagaaaataccgcaactgtattgctcatcttactgtagttcgtgaactgaaagaatacataggagatattcgtacagtggattcttacttctccatttatcattatgttatgcagcgttgtatcacgaaaaggggagatgacacaaagcaagaagagaaaataaagtatgaggacgatcttttaaaaaatcacggctatacgaaagactttgtaaaggctctcaactcgccgtttggatacaacattccgaggtttaaaaatctttcaattgagcagttgtttgacagaaatgaatatcttactgaaaagtag

SEQ ID NO: 142 - DNA, 2715 bp, Artificial Sequence
  Human codon-optimized Gut metagenome P1E0 nCas1
gaaagggaggtgaagaagcctcccaagaaatccctggccaaagccgccggactgaagtccacattcgtcatcagcccccaggaaaaggaactcgctatgaccgcctttggcagaggcaacgatgccctgctgcaaaagagaatcgtggacggcgtggtccgtgatgttgccggagagaaacagcagttccaggtccagaggcaagacgagagcagattcagactccaaaactccagactggccgataggaccgtcaccgctgacgaccccctccacagggctgaaacacccaggagacagcctctgggcgctggcatggatcagctgaggagaaaagccattctggagcaaaagtactttggcaggacattcgacgacaacatccacatccagctgatctacaacatcctggacatccacaagatgctggctgtgcctgctaaccatatcgtgcacaccctgaacctcctgggaggctacggcgaaactgattttgtgggaatgctgcctgccggactcccctacgataagctcagggtcgtgaagaaaaaaaatggcgataccgtcgacatcaaggccgacattgctgcctatgccaaaagaccccagctggcttacctgggagctgccttctatgacgtgacccctggaaaaagcaagcgtgatgctgccaggggcagggtgaagagggaacaggacgtctatgccattctgtccctcatgtccctgctgagacaattctgcgcccacgatagcgtcaggatctggggccagaataccaccgccgccctgtaccacctccaggccctgccccaggatatgaaggacctgctggacgacggctggaggagagctctgggaggcgtgaatgaccatttcctcgacaccaacaaggtgaacctcctcaccctcttcgagtactatggcgccgaaaccaagcaggctagggtggccctgacacaggacttttacaggttcgtggtgctgaaggagcagaagaacatgggctttagcctcaggaggctgagggaagagctgctgaagctgcccgacgccgcttacctgaccggacaggagtacgactccgtgaggcagaaactgtacatgctcctggacttcctgctgtgcaggctgtacgcccaggagagagccgatagatgcgaagagctggtgagcgccctcagatgtgctctgagcgacgaggagaaggatacagtctaccaagctgaagccgctgccctgtggcaagccctgggcgacacactcaggaggaaactcctccccctcctgaagggcaagaaactgcaagacaaggataagaaaaagtccgacgaactcggcctgtccagggatgtgctcgatggcgtgctctttagacctgcccagcagggcagcagagccaacgccgactacttttgtaggctcatgcacctgagcacctggtttatggacggcaaggagatcaataccctgctgaccaccctgatctccaagctggagaatatcgatagcctgaggtccgtcctggagtccatgggcctggcctatagctttgtccctgcctacgccatgtttgaccacagcagatacatcgctggccagctgagggtggtgaacaacatcgccagaatgaggaaacccgccattggagccaaaagagagatgtacagggccgctgtcgtgctgctcggagtggacagccccgaagctgctgccgccattacagacgatctgctgcagatcgatcccgaaactggaaaggttcgtcctagatccgactccgctagagacaccggactgaggaacttcatcgctaacaacgtcgtggagagcaggaggttcacctacctcctgagatacatgacccctgaacaggccagggtcctggctcaaaacgagaagctgattgccttcgtgctcagcacagtgcccgacacccagctggagaggtattgtaggacctgtggaagggaggacatcacaggcaggcccgcccagattaggtatctgaccgctcagatcatgggcgtgaggtacgaaagctttaccgacgtggaacagaggggaaggggcgataatcctaaaaaggagagatacaaggccctgatcggcctctacctgacagtgctgtatctggccgtcaaaaatatggtgaattgtaacgccaggtacgtgatcgccttctactgcagggatagggacaccgccctctaccagaaggaagtgtgttggtatgacctggaggaggacaagaagtccggaaagcaaagacaggtcgaggactatacagccctgaccagatatttcgtgtcccagggctacctgaacagacacgcctgcggctatctcaggtccaacatgaacggcatcagcaacagcctgctgaccgcctacagaaatgccgtggaccacctgaacgccattcctcctctgggctccctgtgtagggacatcggcagagtggattcctacttcgctctgtaccactacgccgtgcaacagtacctcaatggaaggtattacagaaaaacacccagagaacaggaactcttcgccgccatggctcagcacaggacctggtgttccgatctcgtgaaggccctgaacacccctttcggatacaacctggccaggtacaagaacctctccatcgacggactgttcgacagggagggcgatcatgtggtgagagaggatggcgaaaaacctgccgaa

SEQ ID NO: 143 - DNA, 2835 bp, Artificial Sequence
  Human codon-optimized Anaerobic Digester  nCas1
aacaacaagagaaaaacaaaggctaaagccgccggcctgaagagcgtttttttcgatcagaagcaggccgtcctgaccacattcgctaaaggcaacaacagccagatcgagaagaaggtggtcaatagcgaagtgaaggacctgagacagccccctgcctttgacctcgaactgaaagaaaaaactttttacatcagcggaaagaataatatcaacaccagcagagagaaccctctggccagcgccagcctgcctctgtccaaaaggcagaggattagggctgagaggatcaagagggccagagaggagaacaggccctaccacaacgtcaaaagggtcggcgaggatgatctgagggccaaagccgacctggagaagcattattttggaaaggaatacagcgataatctcaagatccagatcatttataacattctggacatcaataagatcatcagcccctacatcaatgacatcgtgtactccatgaacaatctggccaggaatgatgagtatatcgacggcaagatcgatgtgatcggttctctgtcctccaccacagactatagcagcttcatgagccccaataaggatctggaaaaggagaagaaattcagctttcacagagaaaactataaaaaatttgtcgaggcctccaagccctacatgagatattacggcaaagtctttatcagggacgtgaaaaaatccaagctgtccaccggcaagggcgaaaagatcgaggtgatgtacaggagcgatgaagagattttcaccatcttccaaatcctgtcctacgtgaggcagagcatcatgcataatgacattggcaacaagagcagcatcctcgccatcgaaaaataccccgccagattcgtgggcttcctgtccgacctcttaaaaactaagaccaacgacgtgaacaggatgttcatcgataacaatagccagacaaatttctgggtcctgttctccatcttcggcctccaggaccatacaagcggcgctgataagatctgcaggaacttctatgatttcgtgatcaaggccgacagcaagaacctgggattctccctgaaaaagatcagggagctcatgctggacctccctaacgctaacatgctcagggatcaccagttcgacacagtgaggagcaagttctataccctcctcgactttatcatttaccagcattacctggaagagaagagcaggatcgacaacatggtcgagaagctcaggatgaccctgaaagaagaggagaaggaggtgctctacgctgccgaagccaagatcgtgtggaatgccattggcgccaaggtcatcaacaagctggtgcctatgatgaacggtgatgctctgaaggagattaaaagaaagaacagggataggaagctgccccagtccgtgatcgctaccgtccaggtgaatagcgatgccaatgtgttttccggcctcatctacttcctcaccctcttcctggacggcaaagagattaacgagatggtgagcaatctcatcaccaagttcgagaatatcgactccctgctgcatgtggatagggagatctataagtccgacgagaaggacctcgacctcgaaatcgagaaactggctctgtttttcaaaggcgtggtcaggcccaacgccaaaacagacacaggagctggcgaaatcagcaagagcttcagcattttccagagcgccgagaggatcatcgaggagctgaaatttatcaagaatgtgacaaggatggacaacgagatctttcccagcgagggagtgttcctggatgctgccaatgtgctgggcgtgagaggagatgacttcgacttttccaacgagttcgtcggcgatgacctccactccgatgccaataaaaagatcatcaacaaaatcaatggcaccaaggaggacaggaacctcagaaacttcattattaataatgtggtgaagagcaggaggttccaatacatcgccaggcacatgaatacccactatgtgaagcagctggccaacaacgagacactgaacaggttcgtgctcaacaaaatgggcgacgccaagattatcaacaggtactatgagtccatcagcggcaacacccccaatatcgaggtcagatcccagattgactacctcgtcaaaagactcaggagcttctccttcgaggacctcaatgacgtgaagcaaaaagtcagacccggcaccaacgaatccatcgagaaggaaaagaaaaaggctctcgtcggactctgcctgacaatccaatatctggtgtacaaaaacctggtcaacatcaacgctaggtacaccacagccttctactgcctggaaagggattccaagctgaagggctttggcgtggatgtgtggagggatttcgagagctacaccgctctgaccaaccacttcatcaaggaaggctatctccccgtcaggaaggccgagattctgagagccaatctgaagcatctggactgcgaggacggcttcaagtattacagaaaccaggtcacccatctgaacgccatcagagtggcttataagtatattaacgaaattaagtccgtgcacagctactttgccctgtaccactacatcatgcagaggcacctctatgactccctccaagccaaagccaaggatagctccggcttcgtcattgacgccctgaagaagtccttcgaacataaaatctacagcaaagacctcctgcacgtgctccattcccctttcggctacaacaccgccaggtacaagaacctgagcatcgaggctctgttcgacaagaatgagagcaggcctgaagtcaaccccctctccaccaacgac

SEQ ID NO: 144 - DNA, 2898 bp, Artificial Sequence
  Human codon-optimized Ruminococcus flavefaciens XPD nCas1
atcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcc

SEQ ID NO: 145 - DNA, 2829 bp, Artificial Sequence
  Human codon-optimized Ruminococcus albus nCas1
gccaagaagtccaagggaatgtccctcagggagaagagggagctggagaagcaaaagaggattcagaaggccgccgtgaatagcgtgaacgatacccctgaaaaaactgaggaggctaatgtggtcagcgtgaacgtgagaaccagcgccgagaacaagcactccaaaaagagcgctgccaaagccctgggcctgaaaagcggcctcgtgattggagatgagctctacctgaccagcttcggaaggggcaacgaagccaagctggagaagaagattagcggcgacaccgtggagaaactgggaattggcgcctttgaggtcgccgaacgtgatgaaagcacactcacactcgagagcggcaggatcaaagacaaaaccgccaggcctaaggaccccagacatattaccgtggacacccagggaaagtttaaggaggacatgctgggcatcaggtccgtgctcgaaaagaagatctttggaaaaaccttcgacgataacatccacgtccagctggcctacaacatcctggacgtcgagaagatcatggctcagtatgtgagcgacatcgtctacatgctgcacaacaccgacaagaccgagaggaacgataacctgatgggatacatgtccattagaaatacctacaaaaccttctgcgacacatccaatctgcccgacgacacaaagcagaaggtggagaatcagaaaagggaattcgacaagatcattaagagcggcagactgggctacttcggcgaagctttcatggtcaacagcggcaactccaccaagctgaggcccgagaaagagatttatcatatcttcgccctcatggccagcctgaggcagagctacttccacggatacgtcaaggataccgactatcagggcacaacatgggcctacacactggaggataagctgaagggccccagccatgaatttagggagacaatcgacaagatctttgacgagggattcagcaagatctccaaggacttcggaaaaatgaacaaagtgaatctccaaatcctggagcagatgatcggcgagctgtacggaagcatcgaaaggcagaacctgacctgcgattactacgattttattcaactcaagaagcacaagtatctcggctttagcatcaagaggctgagagagacaatgctcgagacaacccctgccgagtgttataaggctgagtgctacaatagcgagaggcaaaagctctacaagctgatcgacttcctcatctacgacctctactataacaggaagcccgccagaatcgaagagatcgtcgacaagctgagagagagcgtcaacgacgaggagaaggagagcatctatagcgtggaggccaagtacgtgtatgagtccctgagcaaggtgctggataagagcctgaagaattccgtgtccggcgaaactatcaaggatctgcagaagaggtacgacgacgaaactgccaacagaatttgggacatctcccagcactccatttccggcaatgtcaactgcttctgcaagctgatctacattatgaccctcatgctggatggaaaggagatcaacgacctcctcaccaccctggtgaacaagtttgacaatattgcttcctttattgacgtgatggacgaactcggcctggaacacagctttacagacaactacaagatgtttgccgacagcaaggccatctgcctggacctgcaattcatcaatagctttgctagaatgagcaagatcgacgacgagaaaagcaagagacagctgttcagggatgctctggtgatcctcgatatcggaaacaaggacgaaacttggattaacaactacctcgactccgacatcttcaagctggacaaggaaggcaacaagctgaagggagccaggcatgactttaggaattttatcgccaataatgtcattaagtcctccagattcaagtacctcgtcaaatacagctccgccgacggcatgattaagttaaaaactaacgaaaagctgattggcttcgtgctcgacaagctccccgaaactcaaatcgataggtactacgaatcctgcggcctcgacaatgccgtcgtggacaagaaggtgaggatcgagaaactgtccggactcatcagggacatgaagttcgacgatttttccggcgtcaagacctccaataaggccggcgacaacgataagcaggacaaggccaagtaccaggccattatctccctgtacctgatggtgctctaccagattgtgaagaatatgatctacgtcaacagcaggtatgtgattgccttccactgcctggagagggacttcggaatgtacggcaaggatttcggcaagtactaccagggctgtaggaagctcaccgatcatttcatcgaggagaaatacatgaaggagggcaagctgggctgtaacaagaaagtcggcaggtacctgaagaataacatcagctgttgcaccgacggcctgattaacacctacaggaaccaggtcgatcatttcgccgtcgtcagaaaaatcggaaattacgccgcctacatcaaatccattggcagctggttcgagctctatcattacgtgattcagaggatcgtttttgacgaatatagattcgccctcaacaacaccgagtccaactataagaacagcatcattaagcaccatacatactgcaaggacatggtgaaggccctgaatacccctttcggctacgacctgcccagatataaaaacctgagcattggtgatttattcgacaggaacaactatctgaacaaaacaaaggagtccatcgatgccaactccagcattgatagccag

SEQ ID NO: 146 - DNA, 330 bp, Ruminococcus sp.
ctactacactggtgcgaatttgcactagtctaaaacaagctttttcttcattgtctacaaatgcaactactacactagtgcgaatttgcactagtctaaaactctatgtagcttttcttgtaaaacatatttctactacactggtgcgattttgcactagtctaaaactcatctgccttctgcatatcggacacttgactactacaccggtgcgaatttgcactagtctaaaacttacacctccttatgcgattttatcgtgcgctactacactggtgcgaatttgcactagtctaaaacttcatcttcaagaccgagcagggacatcat

SEQ ID NO: 147 - protein, 939 aa, Artificial Sequence
  Metagenomic hit (no protein accession):  contig emb|OBVH01003037.1, human gut metagenome sequence (also found in WGS contigs emb|OBXZ01000094.1| and emb|OBJF01000033.1|)
MAKKKRITAKERKQNHRELLMKKADSNAEKEKAKKPVVENKPDTAISKDNTPKPNKEIKKSKAKLAGVKWVIKANDDVAYISSFGKGNNSVLEKRIMGDVSSNVNKDSHMYVNPKYTKKNYEIKNGFSSGSSLVTYPNKPDKNSGMDALCLKPYFEKDFFGHIFTDNMHIQAIYNIFDIEKILAKHITNIIYTVNSFDRNYNQSGNDTIGFGLNYRVPYSEYGGGKDSNGEPKNQSKWEKRDNFIKFYNESKPHLGYYENIFYDHGEPISEEKFYNYLNILNFIRNNTFHYKDDDIELYSENYSEEFVFINCLNKFVKNKFKNVNKNFISNEKNNLYIILNAYGKDTENVEVVKKYSKELYKLSVLKTNKNLGVNVKKLRESAIEYGYCPLPYDKEKEVAKLSSVKHKLYKTYDFVITHYLNSNDKLLLEIVETLRLSKNDDEKENVYKKYAEKLFKADDVINPIKAISKLFARKGNKLFKEKIIIKKEYIEDVSIDKNIYDFTKVIFFMTCFLDGKEINDLLTNIISKLQVIEDHNNVIKFISNNKDAVYKDYSDKYAIFRNAGKIATELEAIKSIARMENKIENAPQEPLLKDALLSLGVSDDTKVLENTYNKYFDSKEKTDKQSQKVSTFLMNNVINNNRFKYVIKYINPADINGLAKNRYLVKFVLSKIPEEQIDSYYKLFSNEEEPGCEEKIKLLTKKISKLNFQTLFENNKIPNVEKEKKKAIITLYFTIVYILVKNLVNINGLYTLALYFVERDGYFYKDICGKKDKKKSYNDVDYLLLPEIFSGSKYREETKNLKLPKEKDRDIMKKYLPNDKDREKYNKFFTAYRNNIVHLNIIAKLSELTKNIDKDINSYFDIYHYCTQRVMFNYCKEKNDVVLAKMKDLAHIKSDCNEFSSKHTYPFSSAVLRFMNLPFAYNVPRFKNLSYKKFFDKQ

SEQ ID NO: 148 - DNA, 36 bp, Artificial Sequence
  DR sequence
gattgaaaggattgtaaatttgcaaggtcttaaaac

SEQ ID NO: 149 - protein, 958 aa, Artificial Sequence
  Metagenomic hit (no protein accession):  contig tpg|DBYI01000091.1| (Uncultivated Ruminococcus flavefaciens UBA1190 assembled from bovine gut metagenome)
MKKKIKARDLREAKKQEKLAAFSAKANTVYENEDKNVEAFPEALNLRSIKKSMNKAAGLKSTLIDGKSLYLTAFGKGNNAVVEHMIATDDSYSLKTLENEPSLKVKAADELKVTFMSRRPFVQESELSAVNPLHSGKDKPNKSAGQDMLGLKSELEKRYFGKIFDDNLHIQIIHNILDIEKIIAVYATNITAAIDHMVDDDNEQYLQGDFIGYMNTLNTYEVFMEPSKNPRLDSNARKNIENSREKFEYLLDTQRLGYLSLEYDKRSKDKRKSEEIKKRLYHLVAFAGQLRQWSFHSVEGLPRTWIYQLDNPKLAQEYRDTLDYFFNERFDAINKDFIETNNINLHILKEVFPAEDFQKLAALYYDFIVKKTFKNIGFSIKNLREQMLECDEAEKIRSKDMNSVRSKLYKLFDFCIFYQYFIDEERSRENVNYLRSTLNDEQKDAFYEEEGKRLWSENRKKFIYFCDNINKWVKNDYSDEVAKCIDLNEFRVNSNVSYFSKLLYAMSFFLDGKEINDLLTTLINKFDNIRSFIDTANFLNIDVKFTKDYDFFNIICDYAGELNIIKNIARMKKPSPSAKKNMYRDALTILGIPTEMSDEQLDAEIDKILEKKINPVTGKTEKGKNPFRNFIANNVIENKRFIYVIKFCNPKNVRKLVNNTKVTEFVLKRMPETQIDRYFESCIEGNLNPTTEKKIEKLAEMIKNIKFEEFRNVKQKVRDNSQEAVEKERFKAIIGLYLTVIYLLVKNLVNVNSRYVMAFHCLERDAKLYGVQNIGGDYLALTAKLCAEGDDYGKKLSEAKQNINQDKVQMPKNYFLARNKRWREAIEQDIDNAKKWFIGEKFNNVKNYRNNVAHLTAIRNCAEFIGEITKIDSYFALYHYLIQRQLAGRLDPNHPGFEKNYPQYAPLFKWNTYVKDMVKALNSPFGYNIPRFKDLSIDALFDRNEMKEETDDEKKIQT

SEQ ID NO: 150 - DNA, 36 bp, Artificial Sequence
  DR 1
gaactatacccctaccaaatggtcggggtctgaaac

SEQ ID NO: 151 - DNA, 37 bp, Artificial Sequence
  DR2
tgaactacacccctgccaagtggttggggtctgaaac

SEQ ID NO: 152 - DNA, 36 bp, Artificial Sequence
  DR3
gaactacacccctaccaagtggttggggtctgaaac

SEQ ID NO: 153 - protein, 877 aa, Artificial Sequence
  Metagenomic hit (no protein accession):  contig tpg|DJXD01000002.1| (uncultivated Ruminococcus assembly, UBA7013, from sheep gut metagenome)
MKKQKSKKTVSKTSGLKEALSVQGTVIMTSFGKGNMANLSYKIPSSQKPQNLNSSAGLKNVEVSGKKIKFQGRHPKIATTDNPLFKPQPGMDLLCLKDKLEMHYFGKTFDDNIHIQLIYQILDIEKILAVHVNNIVFTLDNVLHPQKEELTEDFIGAGGWRINLDYQTLRGQTNKYDRFKNYIKRKELLYFGEAFYHENERRYEEDIFAILTLLSALRQFCFHSDLSSDESDHVNSFWLYQLEDQLSDEFKETLSILWEEVTERIDSEFLKTNTVNLHILCHVFPKESKETIVRAYYEFLIKKSFKNMGFSIKKLREIMLEQSDLKSFKEDKYNSVRAKLYKLFDFIITYYYDHHAFEKEALVSSLRSSLTEENKEEIYIKTARTLASALGADFKKAAADVNAKNIRDYQKKANDYRISFEDIKIGNTGIGYFSELIYMLTLLLDGKEINDLLTTLINKFDNIISFIDILKKLNLEFKFKPEYADFFNMTNCRYTLEELRVINSIARMQKPSADARKIMYRDALRILGMDNRPDEEIDRELERTMPVGADGKFIKGKQGFRNFIASNVIESSRFHYLVRYNNPHKTRTLVKNPNVVKFVLEGIPETQIKRYFDVCKGQEIPPTSDKSAQIDVLARIISSVDYKIFEDVPQSAKINKDDPSRNFSDALKKQRYQAIVSLYLTVMYLITKNLVYVNSRYVIAFHCLERDAFLHGVTLPKMNKKIVYSQLTTHLLTDKNYTTYGHLKNQKGHRKWYVLVKNNLQNSDITAVSSFRNIVAHISVVRNSNEYISGIGELHSYFELYHYLVQSMIAKNNWYDTSHQPKTAEYLNNLKKHHTYCKDFVKAYCIPFGYVVPRYKNLTINELFDRNNPNPEPKEEV

SEQ ID NO: 154 - DNA, 36 bp, Artificial Sequence
  DR
caactacaaccccgtaaaaatacggggttctgaaac

SEQ ID NO: 155 - protein, 984 aa, Artificial Sequence
  Metagenomic hit (no protein accession): contig OGZC01000639.1 (human gut metagenome assembly)
MKKKNIRATREALKAQKIKKSQENEALKKQKLAEEAAQKRREELEKKNLAQWEETSAEGRRSRVKAVGVKSVFVVGDDLYLATFGNGNETVLEKKITPDGKITTFPEEETFTAKLKFAQTEPTVATSIGISNGRIVLPEISVDNPLHTTMQKNTIKRSAGEDILQLKDVLENRYFDRSFNDDLHIRLIYNILDIEKILAEYTTNAVFAIDNVSGCSDDFLSNFSTRNQWDEFQNPEQHREHFGNKDNVICSVKKQQDLFFNFFKNNRIGYFGKAFFHAESERKIVKKTEKEVYHILTLIGSLRQWITHSTEGGISRLWLYQLEDALSREYQETMNNCYNSTIYGLQKDFEKTNAPNLNFLAEILGKNASELAEPYFRFIITKEYKNLGFSIKTLREMLLDQPDLQEIRENHNVYDSIRSKLYKMIDFVLVYAYSNERKSKADALASNLRSAITEDAKKRIYQNEADQLWTSYQELFKRIRGFKGAQVKEYSSKNMPIPIQKQIQNILKPAEQVTYFTKLMYLLTMFLDGKEINDLLTTLINKFDNISSLLKTMEQLELQTTFKEDYTFFQQSSRLCKEITQLKSFARMGNPISNLKEVMMVDAIQILGTEKSEQELQSMACFFFRDKNGKKLNTGEHGMRNFIGNNVISNTRFQYLIRYGNPQKLHTLSQNETVVRFVLSRIAKNQRVQGMNGKNQIDRYYETCGGTNSWSVSEEEKINFLCKILTNMSYDQFQDVKQSGAEITAEEKRKKERYKAIISLYLTVLYQLIKNLVNINARYIIAFHCLERDAILYSSKFNTSINLKKRYTALTEMILGYETDEKARRKDTRTVYEKAEAAKNRHLKNVKWNCKTRENLENADKNAIVAFRNIVAHLWIIRDADRFITGMGAMKRYFDCYHYLLQRELGYILEKSNQGSEYTKKSLEKVQQYHSYCKDFLHMLCLPFAYCIPRYKNLSIAELFDRHEPEAEPKEEASSVNNSQFITT

SEQ ID NO: 156 - DNA, 33 bp, Artificial Sequence
  DR 1
actacaatccatggttatcgtggatactaaaac

SEQ ID NO: 157 - DNA, 33 bp, Artificial Sequence
  DR2
actacaatccacgtttatcgtggatactaaaac

SEQ ID NO: 158 - protein, 978 aa, Artificial Sequence
  Metagenomic hit (no protein accession): contig emb|OHBM01000764.1 (human gut metagenome assembly)
  misc_feature (1)..(222): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHPLQKRYRYLTSTNLKSFETYKNNLVNKKKFDLDRVKKIPQLAYFGSAFYNTPEDTSAKITKTKIKSNEEIYYTFMLLSTARNFSAHYLDRNRAKSSDAEDFDGTSVIMYNLDNEELYKKLYNKKVHMALTGMKKVLDANFNKKVEHLNNSFIKNSAKDFVILCEVLGIKSRDEKTKFVKDYYDFVVRKNYKHLGFSVKELRELLFANHDSNKYIKEFDKISNKKFDSVRSRLNRLADYIIYDYYNKNNAKVSDLVKYLRAAADDEQKKKIYLNESINLVKSGILERIKKILPKLNGKIIGNMQPDSTITASMLHNTGKDWHPISENAHYFTKWIYTLTLFMDGKEINDLVTTLINKFDNIASFIEVLKSQSVCTHFSEERKMFIDSAEICSELSAMNSFARMEAPGASSKRAMFVEAARILGDNRSKEELEEYFDTLFDKSASKKEKGFRNFIRNNVVDSNRFKYLTRYTDTSSVKAFSNNKALVKFAIKDIPQEQILRYYNSCFGASERYYNDGMSDKLVEAIGKINLMQFNGVIQQADRNMLPEEKKKANAQKEKYKSIIRLYLTVCYLFFKNLVYVNSRYYSAFYNLEKDRSLFEINGELKPTGKFDEGHYTGLVKLFIDNGWINPRASAYLTVNLANSDETAIRTFRNTAEHLEALRNADKYLNDLKQFDSYFEIYHYITQRNIKEKCEMLKEQTVKYNNDLLKYHGYSKDFVKALCVPFGYNLPRFKNLSIDALFDKNDKREKLKKGFED

SEQ ID NO: 159 - DNA, 36 bp, Artificial Sequence
  DR
gaactacagccctccttaaatggggggttctaaaac

SEQ ID NO: 160 - protein, 1023 aa, Artificial Sequence
  Metagenomic hit (no protein accession): contig emb|OHCP01000044.1 (human gut metagenome assembly)
MAKKITAKQKREEKERLNKQKWAKNDSVIIVPETKEEIKTGEIQDNNRKRSRQKSQAKAMGLKAVLSFDNKIAIASFVSSKNAKSSHIERITDKEGTTISVNSKMFESSVNKRDINIEKRITIEEPQQDGTIKKEEKGVKSTTCNPYFKVGGKDYIGIKEIAEEHFFGRAFPNENLRVQIAYNIFDVQKILGTFVNNIIYSFYNLSRDEVQSDNDVIGMLYSISDYDRQKETETFLQAKSLLKQTEAYYAYFDDVFKKNKKPDKNKEGDNSKQYQENLRHNFNILRVLSFLRQICMHAEVHVSDDEGCTRTQNYTDSLEALFNISKAFGKKMPELKTLIDNIYSKGINAINDEFVKNGKNNLYILSKVYPNEKREVLLREYYNFVVCKEGSNIGISTRKLKETMIAQNMPSLKEENTYRNKLYTVMNFILVRELKNCATIREQMIKELRANMDEEEGRDRIYSKYAKEIYLYVKDKLKLMLNVFKEEAEGIIIPGKEDPVKFSHGKLDKKEIESFCLTTKNTEDITKVIYFLCKFLDGKEINELCCAMMNKLDGISDLIETAKQCGEDVEFVDQFKCLSKCATMSNQIRIVKNISRMKKEMTIDNDTIFLDALELLGRKIEKYQKDKNGDYVKDEKGKKVYTKDYNNFQDMFFEGKNHRVRNFVSNNVIKSKWFSYVVRYNKPAECQALMRNSKLVKFALDELPDSQIEKYYISVFGEKSSSSNEEMRRELLKKLCDFSVRGFLDEIVLLSEDEMKQKDKFSEKEKKKSLIRLYLTIVYLITKSMVKINTRFSIACATYERDYILLCQSEKAERAWEKGATAFALTRKFLNHDKPTFEQYYTREREISAMPQEKRKELRKENDQLLKKTHYSKHAYCYIVDNVNNLTGAVANDNGRGLPCLSEKNDNANLFLEMRNKIVHLNVVHDMVKYINEIKNITSYYAFFCYVLQRMIIGNNSNEQNKFKAKYSKTLQEFGTYSKDLMWVLNLPFAYNLPRYKNLSNEQLFYDEEERMEKIVGRKNDSR

SEQ ID NO: 161 - DNA, 36 bp, Artificial Sequence
  DR
gtactaaagcccgctagtatagacgggttctaagac

SEQ ID NO: 162 - protein, 926 aa, Artificial Sequence
  Metagenomic hit (no protein accession): contig emb|OGDF01008514.1| (human gut metagenome assembly)
MTETKPKREDIAKTPAAKSRSKAAGLKSTFAVNGSVLLTSFGRGNDAVPEKLITEKAVSEINTVKPRFSVEKPATSYSSSFGIKSHISATADNPLAGRAPVGEDAIHAKEVLEQRVFGKTFSDDNIHIQLIYNILDIRKILSTYANNVVFTINSMRRLDEYDREQDYLGYLYTGNSYERLLDIADKYAVDGEDWRNTAAGISNDFEKKQFQTINGFWDLLDMIEPYMCYFSEAFFCETTVKDPDSGRIVPCLEQRSDGDIYNILRILSIVRQTCMHDNASMRTVMFTLGQNSVRDRKNGFDELAELLDYLYDEKIDIVNRDFLRNQKNNIELLSRIYGSSADSPERDRLVQNFYDFRVLSQDKNLGFSIKKLREKLLDSPALSVVRSKKYDTMRSKIYSLIDFMIYRKFSENHVAVDDFVEELRSLLTEDEKESAYSRWAETLINDGFAQEILVKLLPQTDPAVIGKIKGKKLLNDSIAGIKLKKDASFFTKIINVLCMFQDGKEINELVSSLVNKFANIQSFVDVMRSQGIDSGFTADYAMFAESGRISRELHILKGIARMQHSIAGLGDVKIYGSDDKFHGVSRRVYTDAAYILGFGERSEDNDGYVDDYVSSKLLGGADKNLRNFITNNVIKNRRFLYTVRYMNPKRAKKLVQNDALVVLALSGIPETQIDRYYKSCIEKRSFNPDLNEKIAALSEMITTLKIDDFEDVKQNPEKNANYEAKKNQRISKERYKACIGLYLTVLYLICKNLVKINARYSIAIGCLERDTQLHGVDFKGAAYMTRDVFIAKGWINPKKPTVKSIKEQYAFLTPYIFTTYRNMIAHLAAVTNAYKYIPQMDRFKSWFHLYHTVIQHSLIQQYEYDRDYGRKGAPVVSERVLQLLEQCREHSNYSRDLLHILNLPFGYNLPRYLNLSSEKYFDANAI

SEQ ID NO: 163 - DNA, 36 bp, Artificial Sequence
  DR
ctactacactggtgcgaatttgcactagtctaaaac

SEQ ID NO: 164 - protein, 1030 aa, Artificial Sequence
  Metagenomic hit (no protein accession): contig emb|OGPN01002610.1 (human gut metagenome assembly)
MAKKITAKQKREEKERLNKQKWAKQDTPVVPKSKTEEKPVAASDDKLLKTTQVKKVQTKSKAKAMGLKTVLSFDDKIAIASFVNDKKTKLPHIERITDKSGTTIHENARMFDSSVDEQNVNIEKRMTIEEKQNDGTFKKDEKDVKATICNPYFKTCGKDYIGIKDVAEKYFFGKTFPNENLRVQIAYNVFDIQKILGTYVNNIIYSFYNLRRDGKSDVDIIGSLYAFADFDNQLKDKPAFREAKDLLKNTEAYFSYFGDVFKKSKKGKKDENNEDYEKNLRHNFNVLRVLSFLRQICTHAYVKCTGGAKNNGDSTKVEAESLDALFNITEYFAKTAPELSKTINEIYKEGIDRINNDFVTNGKNNLYILSKVYPDMQRNELVKKYYQFVVCKEGNNVGINTRKLKESIISQHPWITTPQDNNKANDYESCRHKLYTIMCFILVAELDAHESIRDNMVAELRANMDGDDGRDAIYEKYAKDIYHIVKDKLLAMQKVFDEELVPVKVEGKNDPQQFTHGKLGKKEIESFCLSDKNTSDIAKVVYFLCNFLDGKEINELCCAMMNKFDGIGDLIDTAKQCGEEVKFIEEFACLSNCRKITNDIRVAKSISKMKNKVNIDNDIIYLDAIELLGRKIEKYQKDENGKILLGTDGKRLYTQEYKYFNDMFFNAGNHKVRNFIANNVMQSKWFFYVVRYNKPAECQIIMRNKTLVKFTLDDLPDMQIQRYYSSVFGDNNMPAVDEMRKRLLDKINQFSVRGFLDELDEIVLMSDEESKRNKSSEKEQKKSLIRLYLTIAYLITKSMVKINTRFSIACAMYERDYALLCQSEMKGGPWDGGAQALAVTRKFLNHDREVFDRYCAREAEIARLPSEERKPLRKANDKLLKQTHYTNHSYTYIVNNLNSFTDIDYCAKDVGLPAPNDKNDNASILGEMRNDIAHLNIVHDMVKYIEELKDISSYYAFYCYVLQRRLVGKDPNCQNKFKAKYAKELNDYGTYNKNLMWMLNLPFAYNLPRYKNLSSEFLFYDMEYNKKDDE

SEQ ID NO: 165 - DNA, 35 bp, Artificial Sequence
  DR
gaacccgtctatactagcgggctttagtacaaaac

SEQ ID NO: 166 - protein, 1001 aa, Artificial Sequence
  Metagenic hit (no protein accession): contig NFIR01000008.1 (Eubacterium sp. An3, from chicken gut metagenome)
MAKKLRPKELREKRRMAEKEEHKKQEKLRKEQEELRKKQEKQREDQKELEKIKKEEGGEGEKKKSGAKALGLKSTFILDRDEQKMLMTSFGRGNKAVRDKYIIGDKVSDIDDSWENKKAALSVEVCGKSFNISKKENDDCEPVKVNNPVLSGNKKDDDLIHCRKNLEEMYFGQQFKDNIHIQLIYNILDIEKILAVQINNIVFILNNLLRWSGEEEFDLIGSLGVNHTYEEFRGRNKNYGKFSELIKQSQMRYFGSTFCLFNENEERITSENKKEWKRFEKKCYHLLAVLGMMRQATAHGDSKRRAEIYKLGKEFDRLEARGCRPEARKELDELYKKKIHEMNQGFLKNSKSDILMLFRIYNAESKEAKRKLAQEYYEFIMLKSYKNTGFSIKHLRETMIDKMDEDKKEKLKDDKYNPIRRKIYRIMDFMIYQYYQEPEHQEEAEELVRKLRNAEIEAKKELAYRKEAEKLKKELEKIIFNSVLPSCDRILSEMDERRNKKVNQESSDTDKEEPLDSEIAEGITFIKETAHSFSEMIYLLTVFLDGKEINILLTQLIHCFDNISSFMDTMEEENLLTKLKEDYEIFEESKEISRELRIINSFARMTEPVPKTERIMFIEAAQILGYSNGEKELEGYVDALLDTKNKTNDKKKKGFVRYIWNNVIKSTRFRYLVRYADPKKVRAFAANKKVVAFVLKDIPDDQIRAYYNSCFRQNSDSSSNNSNASWDADSNKRDISVSDMRKALTEKITGLNFGDFEEESKKGIRKEESDKNIIRLYLTVLYLVQKNLIYVNSRYFLAFHCAERDEMLYNGETIDNNKEKGSEKDWRKFAKQFIMEHSPKKKVKDYLAKNFEYSNKWSLKEFRNSVQHLNVIRDAHKYIKYINDNKDVQSYFALYHYLVQRYISERAANRTDKESLSEGRLQYYLSQVKEYRTYCKDFVKALNVPFAYNLPRYKNLSIDELFDRNNYLPNKAKKWIPEKKENGEYVMEDCGNKDAGQVENA

SEQ ID NO: 167 - DNA, 35 bp, Artificial Sequence
  DR
gaactacactctggctgaaagtcagggtctaaaac

SEQ ID NO: 168 - protein, 1006 aa, Artificial Sequence
  Metagenomic hit (no protein accession): contig NFLV01000009.1 (Eubacterium sp. An11, from chicken gut metagenome)
MSKKQRPKDIRKRQEEEKREKYKKQEELRKKQEELRKEQEQRREDQKELEKIKKEVGEEGEKKKSRAKALGLKSTFILDRDEQKVLMTSFGQGNKAVRDKYIIGDKVSDINDDRKNKKAALLVEVCGKSFNISKKENDDCDPVKVNNPVVSRNKKDDDLIHCRKKLEELYFGEQFKDNIHIQLIYNILDIEKILAVQVNNIVFALNNLLSWSGEEKFDLIGYLGVNDTYEKFRDAKGKRKGLYEKFSTLIEKKRMRYFGSTFYPLNEKGEEITSNDKKEWEQFEKKCYHLLAVLGMMRQATAHGDSKRRAEIYKLGKEFDKSEARGCRQEARKELDDLYRKKIHEMNQSFLKNSKRDILMLFRIYDAESKEAKRKLAQEYYEFIMLKSYKNTGFSIKHLRETVIDKMDEDIKEKIKDDKYNPIRRKLYRIMDFVIYQYYQESEQQEEAMELVRKLRNAETKVEKELTYRKEAEKLKEELEKIIRNSILSVCDRILAEMNEKRHKKVNQESSDTDSEEPLDPEISEGITFIKETAHSFSEMIYLLTVFLDGKEINILLTQLIHCFDNISSFMDTMKEENLLTKLKEDYEIFEESKEISKELRIINSFARMTEPVPKTEKTMFIDAAQILGYSNDEKELEGYVDALLDTKNKTKDKERKGFEKYIWNNVIKSTRFRYLVRYADPKKVRAFAANKKVVAFVLKDIPDEQIKAYYNSCFSQNSDSSSNMSIAFQDGDSNKKGTSVHDMMRKALTEKITGLNFGDFEEESKKGIRREESDKNIIRLYLTVLYLVQKNLIYVNSRYFLAFHCAERDEVLYNGETIDNNKEKGSEKDWKKFAKEFIIEHPPKKKVKDYLAKNFEYSNKWSLRVFRNSVQHLNVIRDAYKYIKCIDDNKDVQSYFALYHYLVQRYISEMAENLTDKGELSEGRLQYYLSQVENYRTYCKDFVKALNVPFAYNLPRYKNLSIDELFDRNNYLPNKAKKWISEKKENGEYVMEDCGNKGAGQVENA

SEQ ID NO: 169 - DNA, 35 bp, Artificial Sequence
  DR
gaactacaccctggctgaaagtcagggtctaaaac

SEQ ID NO: 170 - protein, 1027 aa, Artificial Sequence
  Metagenomic hit (no protein accession): from contig emb|OBLI01020244 and emb|OBLI01038679 (from pig gut metagenome)
MAKKITAKQRREERERQNKQKWAKKQADATAVFECEADIKPADSKDEDCTNIYIKREKKKTQAKAMGLKTVLGFDNKIAIASFMSSKDSKSSHIERITDPNGKTIREDVRMFDSNVDECSINLEKRMTVEERQKDGTIKKDEKDVKSTICNPYSNECGKDYIGIKSVAEELFFGRTFPNDNLRVQIAYNIFDIQKILGTYINNIIYSFYNLSRDESQSDNDVIGTLYMLKDFDGQKETDTFRQARALLERTEAYYSYFDNVFKKIDKNKKKSDDCKRERNEILRYNFNVLRVLSFLRQICAHAQVKISNEHDREKGGGLVDSLDALFNISRFFDAVAPELNEVINSVYSKGIDDINDNFVKNGKNNFYILSKIYPEVAREDLLREYYYFVVSKEGNNIGISTKKLKEAIIVQDMSYIKSEDYDTYRNKLYTVLCFILVKELNERTTIREQMVADLRANMNGDIGREDIYSKYAKIIYAQVKPRFDTMKSAFEEEAKDVIVPDKKKPVKFSHGKLDKNEIERFCITSANTDSVAKIIYFLCKFLDGKEINELCCAMMNKLDGINDLIETAEQCGAKVEFVDKFSVLSNCETISDQIRIVKSISKMKKEIAIDNDTIFLDALELLGRKIDKYKKDATGKYLKDENGKYLYSKEYDDFQYMFFKDSHRVRNFISNSVIKSKWFSYIVRYNQPSECRAIMKNKTLVKFALDELPDLQIQRYFVALYGDEDLPSYGEMRKILLKKLHDFSIKGFLDEIVLLSDLDMESQDKYCEKEQKKSLFRLYLTIAYLITKSMVKINTRFSIACATYERDYALLCASNKQERAWSSGATALALTRRFLNQDKLIFEKHYAREGEISKLPKEERKAMRKVNDQLLKRTHFSKHSYCYIVDNVNRLTGGECRTDKRVLPVLNEKNDNAGILLDFRKTIAHLNVVHKMVDYVDEIKGITSYYAFFCYVLQRMLVGNNLNEKNAIKEKYSATVKSFGTYSKDFMWLINLPFAYNLPRYKNLSNEQLFYDEEERNETEEQIDRL

SEQ ID NO: 171 - protein, 39 aa, Artificial Sequence
  Motif 1
  MISC_FEATURE (3)..(3): Xaa can be Ile, Met, or Val
  misc_feature (4)..(4): Xaa can be any naturally occurring amino acid
  MISC_FEATURE (5)..(5): Xaa can be Asn or Ser
  misc_feature (6)..(7): Xaa can be any naturally occurring amino acid
  misc_feature (9)..(9): Xaa can be any naturally occurring amino acid
  misc_feature (11)..(11): Xaa can be any naturally occurring amino acid
  MISC_FEATURE (12)..(12): Xaa can be Ala, Ile, Leu, or Val
  MISC_FEATURE (13)..(13): Xaa can be Lys or Arg
  MISC_FEATURE (14)..(14): Xaa can be Phe, His, or Tyr
  misc_feature (15)..(16): Xaa can be any naturally occurring amino acid
  MISC_FEATURE (17)..(17): Xaa can be Ala, Pro, or Thr
  misc_feature (18)..(25): Xaa can be any naturally occurring amino acid
  MISC_FEATURE (26)..(26): Xaa can be Cys or Asn
  misc_feature (27)..(31): Xaa can be any naturally occurring amino acid
  MISC_FEATURE (32)..(32): Xaa can be Phe or Leu
  misc_feature (33)..(33): Xaa can be any naturally occurring amino acid
  misc_feature (35)..(36): Xaa can be any naturally occurring amino acid
  MISC_FEATURE (37)..(37): Xaa can be Ile, Leu, Met, or Val
  MISC_FEATURE (38)..(38): Xaa can be Ala, Gly, or Pro
  MISC_FEATURE (39)..(39): Xaa can be Asp, Glu, or Lys
NVXXXXXFXYXXXXXXXXXXXXXXXXXXXXXXXLXXXXX

SEQ ID NO: 172 - protein, 33 aa, Artificial Sequence
  Motif 2
  misc_feature (2)..(2): Xaa can be any naturally occurring amino acid
  MISC_FEATURE (3)..(3): Xaa can be Phe or Leu
  misc_feature (4)..(4): Xaa can be any naturally occurring amino acid
  MISC_FEATURE (5)..(5): Xaa can be Ile or Val
  misc_feature (6)..(6): Xaa can be any naturally occurring amino acid
  misc_feature (8)..(10): Xaa can be any naturally occurring amino acid
  MISC_FEATURE (12)..(12): Xaa can be Asn or Ser
  MISC_FEATURE (13)..(13): Xaa can be Ile, Leu, or Met
  MISC_FEATURE (14)..(14): Xaa can be Ile or Val
  misc_feature (15)..(16): Xaa can be any naturally occurring amino acid
  MISC_FEATURE (18)..(18): Xaa can be Ala, Gly, Ser, or Thr
  misc_feature (19)..(19): Xaa can be any naturally occurring amino acid
  MISC_FEATURE (20)..(20): Xaa can be Phe or Tyr
  misc_feature (21)..(22): Xaa can be any naturally occurring amino acid
  MISC_FEATURE (23)..(23): Xaa can be Ala or Gly
  misc_feature (24)..(27): Xaa can be any naturally occurring amino acid
  MISC_FEATURE (28)..(28): Xaa can be Asp or Glu
  misc_feature (31)..(32): Xaa can be any naturally occurring amino acid
  MISC_FEATURE (33)..(33): Xaa can be Phe, Leu, or Met
LXXXXXYXXXKXXXXXNXXXXXXXXXXXRDXXX

SEQ ID NO: 173 - protein, 19 aa, Artificial Sequence
  Motif 3
  misc_feature (5)..(5): Xaa can be any naturally occurring amino acid
  MISC_FEATURE (6)..(6): Xaa can be Leu or Met
  misc_feature (7)..(7): Xaa can be any naturally occurring amino acid
  MISC_FEATURE (8)..(8): Xaa can be Cys, Ser, or Thr
  MISC_FEATURE (9)..(9): Xaa can be Ala, Asn, Gln, Ser, or Thr
  MISC_FEATURE (10)..(10): Xaa can be Ile, Leu, or Met
  MISC_FEATURE (11)..(11): Xaa can be Ile, Met, or Val
  misc_feature (12)..(13): Xaa can be any naturally occurring amino acid
  MISC_FEATURE (14)..(14): Xaa can be Phe or Leu
  MISC_FEATURE (15)..(15): Xaa can be Ala, Asp, Glu, or Gln
  MISC_FEATURE (16)..(16): Xaa can be Gly, Asn, or Val
  misc_feature (18)..(18): Xaa can be any naturally occurring amino acid
  MISC_FEATURE (19)..(19): Xaa can be Asp, Glu, Asn, or Ser
KEINXXXXXXXXXXXXIXX

SEQ ID NO: 174 - protein, 18 aa, Artificial Sequence
  Motif 4
  MISC_FEATURE (3)..(3): Xaa can be Ala or Gly
  MISC_FEATURE (5)..(5): Xaa can be Cys, Asp, Asn, or Val
  misc_feature (6)..(6): Xaa can be any naturally occurring amino acid
  MISC_FEATURE (7)..(7): Xaa can be Ala, Pro, or Val
  MISC_FEATURE (9)..(9): Xaa can be Phe or Tyr
  misc_feature (10)..(10): Xaa can be any naturally occurring amino acid
  MISC_FEATURE (11)..(11): Xaa can be Asp or Asn
  MISC_FEATURE (13)..(13): Xaa can be Ser or Thr
  misc_feature (14)..(17): Xaa can be any naturally occurring amino acid
PFXYXXXRXXXLXXXXXF

SEQ ID NO: 175 - protein, 979 aa, Artificial Sequence
  Metagenomic hit (no protein accession):  contig OJMM01002900 human gut metagenome sequence
MGKHLNAKQRKLEKKLKNQQKDMMYTKSTDAVSVPTLKAAPTKAEMSQDTAEASTLITPGTLKTKAKAMGLKSTLVFDDKIVVTSFLNSKTEENEKCAHIEKIADCNGQTIVERPRMFNTSINAKKVDLSKDNDETNYPNPAFEDCGRDYINVKSALEKRVFGKTYNKDNLHVQIAYNIFDIKKIIGAYINNIIYIFYNLGREEYDAKKDIIGTQDSAYISKILNNTSAYFTYFDGVFKQITDRDSNKDREIKNSYNALVLKVLYYLRQFCMHGNTYTKRNEESFLSDTALYNAKEFFAKADPQINELIDAVYADGIKTINSDFMAHAKNNMYIICEVYKNEAEDSLMKEYYDFVVRKEGNNLGFNTRQLREILIDKYVGNLRGKKYNTFRNKLYTVLGFILVKEIKRNPKIQDSFIAKLRANQNGDEGKLNIYNEFAPKIWSVVSSKLNSAITCFDEESLSKFKGYKDIDESLISRYGITVANTDTLVKILYFLCKFLDGKEINELCCAMINKFDNINDLIKTAAQCGEDIEFVKEYKLFINSNDLSDQIRIVKSISKMKPELSKIGEALILDAIDILGYKINKYKYDAAGNRLVDSNNKPVYSEEYCAFKKDFFETCELDEFGRVKYNKKGKPVINHRRRNFIINNVLSSKWFFYVAKYNRPSECQKFMKSKKLIALVLKDVPETQIARYYQSVTGGRTQANSEAMRMTLIKLLHEFSIKNVLSDVGTMTASENKRQIENSRKERMKAIVKLYLTVVYLIAKSLVKVNTRFSIAFSAYERDVSLLADENELIALANNEDDKWKKGNYVFALTKHFWDNDEPYFDKYNNALQQIRSIVDPNERRLAYRANDKVVKHTHFNLHSYKYVKHNYEEISKASKIITAYRNNVQHLNVMNSITKYLGDISEVTSYYSLYCYTLQRLLLDDNNNDKFASIKGNLRKFGIYNKDFMWLLNIPFAYNLPRYKNLSNEEIFYDELQK

SEQ ID NO: 176 - DNA, 36 bp, Artificial Sequence
  Direct repeat
gtacaatagccctctcgtagttgagggctctgagac

SEQ ID NO: 177 - protein, 1009 aa, Artificial Sequence
  Metagenomic hit (no protein accession):  contig ODAI011611274.1 gut metagenome sequence
MKKKISLKEQRNTKKAENKLKYQKAQAERAAAAQQTAAGAESEENPCFDVVKDTKRKALNPLHVEIEAPSAKKSSVKANGLKSLLLTDGKTVMTSFGRGSEANVEKRFDETGTKTFDRDPELFSAKPLETGYRIQRFNASPKDAGLAYRPAGVRPDQIGAKAALEKRYFGKETPGDNIHVQIAYQIQDIEKLLAVYISNIIYAVNNVTGVSAMKDSKGRPVDLLGDYGILGEEGLTKRLQRIPEQADEEAKALQAFLCSERLSYFGKEFCLVRNSPKQPDKEEKRQYKLMRVLCLLGELRQFLVHGKKKEKEFAWLYRLDRQLSQEYRKLLGEFYDAQVDKVNKSFLTNSTVNLEVLFRALKTGTDPERKTVTQEYYQFTVRKEDGNLGFSLKTLREILLSAYKHEVRDKEYDSIRHKLYQLFSFALYHYYKTGVGAERREAFVAKLRAVMTAEAKQRAYADEAAEIWNDEGSGIRAAFLEILEAVDFGSAVKGIKARSSVAGDKRFAEWLEEVRIRPEGVSCFTKLMYLLTRFLDGKEINELLTGLINKLENIQSFLDVMQQEHAETGLSDAFSFFEYSGEIAAELRMTRSFARMAAADPEAKRFMVVDGAKLLGFNPKDTESEDEGIIRAIYGDACAEYLQFSEEEKEAFYVQEGLYGKEREKFSPYAYFHTDTSLRNFIAKNVVESARFRYVIRYVSPEIARKYARQEALVRFALHRVPLLQLRRYYQSCCGPKKDPDAAECVDFLAGVVNRVDFANFTDVRTGDSSKSEQEKKQKYQAIVGLYLTVVYWIVKNLVNVNSRYVMAFHILERDTVLLEGKRLFVGGMKAEDPFLLTDGYVSRQDAYVRKRIGENKRANRHGLNCVLENRNALGSDPASTDAAASLIWSYRNAAAHLTAVAAAQEYVSELREIHSYFEVYHYAMQRYLKSGAEFAELVSKNGPASGKIAAWANAVDRCHSFCKDWLWLLNVPFAYNPARYKNLSIANLFDKNEAAPVTEDASEQKEDE

SEQ ID NO: 178 - DNA, 36 bp, Artificial Sequence
  Direct repeat
gtactacacccctgcagttttgcaggggtctgaaac

SEQ ID NO: 179 - protein, 961 aa, Artificial Sequence
  Metagenomic hit (no protein accession):  contig OIZX01000427.1
MAKKKKTARQLREEMQQQRKQAIQKQQEQRQEKAAAARETAAPEQPAAAPVPKRQRKSLAKAAGLKSNFILDPQRRTTVMTAFGQGSTAILEKQIVDRAISDLQPVQQFQVEPASAAKYRLKNSRVRFPNVTADDPLYRRKDGGFVPGMDALRRKNVLEQRFFGKSFADNIHIQMIYSILDIHKILAAASGHIVHLLNIVNGSKDRDFIGMLAAHVLYNELNEEAKRSIADFCKSPRLIYYSAAFYETLDNGKSERRSNEDIFNILALMTCLRNFSSHHSIAIKVKDYSAAGLYNLRRLGPDMKKMLDTFYTEAFIQLNQSFQDHNTTNLTCLFDILNISDSARQKQLAEEFYRYVVFKEQKNLGFSVRKLREEMLLLPDAAVIADKRYDTCRSKLYNLMDFLILRVYRTGRADRCDKLPEALRAALTDEEKAVVYHKEALSLWNEMRTLILDGLLPQMTPENLSRLSGQKRKGELSLDDAMLKECLYEPGPVPEDAAPEEANAEYFCRMIYLATLFMDGKEINTLLTTLISKFENIAAFLQTMEQLNIEAELGPEYAMFTRSRAVAEQLRVINSFALMKKPQVNAKQQLYRAAVTLLGTEDPDGVTDEMLCIDPVTGKMLPPNQRHHGDTGLRNFIANNVVESRRFQYLIRYSDPAQLHQLASNKKLVRFVLSSIPDTQINRYYETCGQTRLAGRAAKVEFLTDMIAAIRFDQFRDVNQKERGANTQKERYKAMLGLYQTVLYLAVKNLVNINARYVMAFHCVERDMFLYDGELTDPKGESVSAFLAVNGKKGVQPQYLLLTQLFIRRDYLKRSACEQIQHNMENISDRLLREYRNAVAHLNVIAHLADYSADMREITSYYGLYHYLMQRHLFKRHAWQIRQPERPTEEEQKLIEQEQKQLAWEKALFDKTLQYHSYNKDLVKALNAPFGYNLARYKNLSIEPLFSKEAAPAAEIKATHA

SEQ ID NO: 180 - DNA, 36 bp, Artificial Sequence
  Direct repeat
actatagccctgccggaaatgacagggttctacaac

SEQ ID NO: 181 - protein, 963 aa, Artificial Sequence
  Metagenomic hit (no protein accession):  contig emb|OCVV012889144.1|
MSKNKESYAKGMGLKSALVSGSKVYMTSFEGGNDAKLEKVVENSEIVSLAEKESFSAEIFKKNIGCKIENKKFKHPKRYDVIADNPLYKGSVRQDMLGLKETLEKRYFNSADGTDNVCIQVIHNILDIEKILAEYITNAVYSFDNIAGFGEDIIGMGGFKPIYTYKQFKEPDKYNKKFDDILNNSRLGYYGKAFFEKNDLKHNPNKKKRDKNPYILKYDNECYYIIALLSGLRHWNIHSHAKDDLVSYRWLYNLDSILNREYISTLNYLYDDIADELTESFSKNSSANVNYIAETLNIDPSEFAQQYFRFSIMKEQKNMGFNVSKLREIMLDRKELSDIRDNHRVFDSIRSKLYTMMDFVIYRYYIEEAAKTEAENRNLPENEKKISEKDFFVINLRGSFDENQKEKLYIEEAKRLWEKLKDIMLKIKEFRGEKVKEYKKEVPRIERILPQGKDISAFSKLMYMLSMFLDGKEINDLFTTLINKFDNIQCFLKIMPLIGVNVKFTEDYAFFNKSEKIADELRLIKSFARMGEPVANTKRVMMIDAVKILGTDLSDDELVNMADSFFNDSEGNLLKKGKHGMRNFIINNVIENKRFHYLIRYGDPAHLHEIAKNEAVVRFVLGRIADIQKKQGKDGKNQIDRYYEICVGKDRGKTVSQKLDELTKIIVNMNYDQFEQKKEIIENTRTKTKYMRYDEEQKLRKDNAEREKFKKIISLYLTVLYYVVKNIVNINSRYVIGFHCLERDAQLYSEKYNKEIDKKISSLTKFCLGESDEKKLKALAKKSLEELKTTNSKLYENYIKYSDERKAEEAKRQINRERAKTAMNAHLRNTKWNDIMYGQLKDLADSKSRICSEFRNKAAHLEVARYAHMYINDISEVKSYFRLYHYIMQRRIIDVIENNPKAKYEGKVKVYFEDVKKNKKYNKNLLKLMCVPFGYCIPRFKNLSIEQMFDMNETDNSDKKKEK

SEQ ID NO: 182 - DNA, 36 bp, Artificial Sequence
  Direct repeat
catatacaaccccgtaaagttacggggttctgaaac

SEQ ID NO: 183 - protein, 911 aa, Artificial Sequence
  Metagenomic hit (no protein accession):  contig OCTW011587266.1
MKQNDRENNNKIKKSAAKAVGVKSLARLSDGSTVVSSFGKGAAAELESLITGGEIRKLSDKAILEITDDTQNKNAYNVKSSRIPNLTARTDKLSDKSGMDDLGFKRELELEVFGQCFDDSIHIQIAHAVFDIQKSLAAVIPNVLYTLNNLDRSYSTDNTSDKKDIIGNTLNYQHSYESFNVEKRGEFTEYYNAAKDRFSYFPDILCVLEKVNGKDRYQPKSEKDAFNVLSSVNMLRNSLFHFAPKSNDGKARIAVFKNQFDSDFSHITSTVNKIYSAKIAGVNENFLNNEGNNLYIILKATNWDIKKIVPQLYRFSVLKSDKNMGFNMRKLREFAVESKNIDLSRLNDKFLTNNRKKLYKVIDFIIYYHLNKVLKDSFVDDFVAALRASQSEEEKEKLYAQYSERLFADEGLKSAIKKAVDMISDTKSNIFKMKTPLDKALIENIKVNSDASDFCKLIYVFTRFLDGKEINILLNSLIKKFQDIHSFNTTVKKLSENNLIINADYVDDYSLFEQSGTVARELMLIKSISKMDFGLDNINLSFMYDDALRTLGVSDENLPEVKREYFGKTKNLSAYIRNNVLENRRFKYVIKYIHPSDVQKIACNKAIAGFVLNRMPDTQIKRYYDSLINKGATDIQAQAKALLDCITGISFDAIKDDKHLHKSKEKSPQRSADRERKKAMLTLYYTIVYIFVKQMLHINSLYTIGFFYLERDQRFIYSRAKKENKNPSKNSYLNDFRSVTAYFIPSEIMKRIEKNENKGFLEDFEALWNSCGKTSRLRKEDVLLYARYISPDHALKNYKMILNSYRNKIAHINVIMSAGKYTGGIKRMDSYFSVFQHLVQCDILSNPNNKGKCFESESLKPLLLDMKFDGTDEKLYSKRLTRALNIPFGYNVPRYKNLTFEKIYLKSSINE

SEQ ID NO: 184 - DNA, 36 bp, Artificial Sequence
  Direct repeat
cttatacaacacccattttcacagtgggtctataac

SEQ ID NO: 185 - protein, 904 aa, Artificial Sequence
  Metagenomic hit (no protein accession):  contig emb|OGNF01009141.1
MADIDKKKSSAKAAGLKSTFVLENNKLLMTSFGNGNKAVIEKIIDEKVDSINEPEVFSVTPCDKKFELQPAKRGLAADSLVDNPLKSKKTAGDDAIHSRKFLERQFFDGNTFNDNIHIQLIYNILDIEKILSVHVNDIVYSVNNILSRGEGMEYNDYIGTLNLKSFETYKNNLVNKKKFDLDRVKKIPQLAYFGSAFYNTPEDTSAKITKTKIKSNEEIYYTFMLLSTARNFSAHYLDRNRAKSSDAEDFDGTSVIMYNLDNEELYKKLYNKKVHMALTGMKKVLDANFNKKVEHLNNSFIKNSAKDFVILCEVLGIKSRDEKTKFVKDYYDFVVRKNYKHLGFSVKELRELLFANHDSNKYIKEFDKISNKKFDSVRSRLNRLADYIIYDYYNKNNAKVSDLVKYLRAAADDEQKKKIYLNESINLVKSGILERIKKILPKLNGKIIGNMQPDSTITASMLHNTGKDWHPISENAHYFTKWIYTLTLFMDGKEINDLVTTLINKFDNIASFIEVLKSQSVCTHFSEERKMFIDSAEICSELSAMNSFARMEAPGASSKRAMFVEAARILGDNRSKEELEEYFDTLFDKSASKKEKGFRNFIRNNVVDSNRFKYLTRYTDTSSVKAFSNNKALVKFAIKDIPQEQILRYYNSCFGASERYYNDGMSDKLVEAIGKINLMQFNGVIQQADRNMLPEEKKKANAQKEKYKSIIRLYLTVCYLFFKNLVYVNSRYYSAFYNLEKDRSLFEINGELKPTGKFDEGHYTGLVKLFIDNGWINPRASAYLTVNLANSDETAIRTFRNTAEHLEALRNADKYLNDLKQFDSYFEIYHYITQRNIKEKCEMLKEQTVKYNNDLLKYHGYSKDFVKALCVPFGYNLPRFKNLSIDALFDKNDKREKLKKGFED

SEQ ID NO: 186 - DNA, 36 bp, Artificial Sequence; identical to SEQ ID NO: 159
  Direct repeat

SEQ ID NO: 187 - protein, 933 aa, Artificial Sequence
  Metagenomic hit (no protein accession):  contig emb|OIEN01002196.1|
MERQKRKMKSKSKMAGVKSVFVIGDELLMTSFGDGDDAVLEKDIDENGVVNDCRNPAAYDAVYGTDSIRVKKTNNNIRAKVNNPLAKSNIRSEESALFRTRVNEYKREQKDKYETLFFGKTFDDNIHIQLISKILDIEKTFSVVIGNIVYAINNLSLEQSIDRPIDIFGDKNTQGISLREDNDYLKTMLPRCEYLFHNILNSDSDNNSKMNYNKVNKGKEEKDNRNNENIEKLKKALEVIKIIRVDSFHGVDGIKGDQKFPRSKYNLAVNYNEEIQKTISEPFNRKVEEVQQDFYRNSCVNIDFLKEIMYGSNYTDRGSDSLECSYFNFAILKQNKNMGFSITSIRECLLDLYELNFESMQNLRPRANSFCDFLIYDYYCKNESERANLVDCLRSAASEEEKKNIYFQTAERVKEKFRNAFNRISRFDASYIKNSREKNLSGGSSLPKYSFIEGFTKRSKKINDNDEKNADLFCNMLYYLAQFLDGKEINIFLTSIHNIFQNIDSFLKVMKEKGMECKFQKDFKMFSHAGHVAKKIEIVISLAKMKKTLDFYNAQALKDAVTILGVSKKHQYLDMNSYLDFYMFDNRSGATGKNAGKDHNLRNFLVSNVIRSRKFNYLSRYSNLAEVKKLAQNPSLVQFVLSRIEPSLICRYYESSQGISSEGITIDEQIKKLTGIIVDMNIDSFENINNGEIGMRYSKATPQSIERRNQMRVCVGLYLNVLYQIEKNLMNVNARYVLAFAFAERDALMLNFTLEECKKNKKRSSGGFSFIEMTQFFIDKKLFKVATEAIKKNVLKYNGNPESLNHIPGEYICKNMEGYHENTVRNFRNMVAHLTAVARVPLYISEVTQIDSYYALYHYCMQMNILQGIEQSGKILDNIKLKNALENARVHRTYSKDAVKYLCLPFAYNISRYKALTIKDLFDWTEYSCKKDE

SEQ ID NO: 188 - DNA, 36 bp, Artificial Sequence
  Direct repeat
gccccttgaccttacgaaatggtaaggttccaaaac

SEQ ID NO: 189 - protein, 1034 aa, Artificial Sequence
  Metagenomic hit (no protein accession):  contig e-k87_11092736
MKRQKTFAKRIGIKSTVAYGQGKYAITTFGKGSKAEIAVRSADPPEETLPTESDATLSIHAKFAKAGRDGREFKCGDVDETRIHTSRSEYESLISNPAESPREDYLGLKGTLERKFFGDEYPKDNLRIQIIYSILDIQKILGLYVEDILHFVDGLQDEPEDLVGLGLGDEKMQKLLSKALPYMGFFGSTDVFKVTKKREERAAADEHNAKVFRALGAIRQKLAHFKWKESLAIFGANANMPIRFFQGATGGRQLWNDVIAPLWKKRIERVRKSFLSNSAKNLWVLYQVFKDDTDEKKKARARQYYHFSVLKEGKNLGFNLTKTREYFLDKFFPIFHSSAPDVKRKVDTFRSKFYAILDFIIYEASVSVANSGQMGKVAPWKGAIDNALVKLREAPDEEAKEKIYNVLAASIRNDSLFLRLKSACDKFGAEQNRPVFPNELRNNRDIRNVRSEWLEATQDVDAAAFVQLIAFLCNFLEGKEINELVTALIKKFEGIQALIDLLRNLEGVDSIRFENEFALFNDDKGNMAGRIARQLRLLASVGKMKPDMTDAKRVLYKSALEILGAPPDEVSDEWLAENILLDKSNNDYQKAKKTVNPFRNYIAKNVITSRSFYYLVRYAKPTAVRKLMSNPKIVRYVLKRLPEKQVASYYSAIWTQSESNSNEMVKLIEMIDRLTTEIAGFSFAVLKDKKDSIVSASRESRAVNLEVERLKKLTTLYMSIAYIAVKSLVKVNARYFIAYSALERDLYFFNEKYGEEFRLHFIPYELNGKTCQFEYLAILKYYLARDEETLKRKCEICEEIKVGCEKHKKNANPPYEYDQEWIDKKKALNSERKACERRLHFSTHWAQYATKRDENMAKHPQKWYDILASHYDELLALQATGWLATQARNDAEHLNPVNEFDVYIEDLRRYPEGTPKNKDYHIGSYFEIYHYIRQRAYLEEVLAKRKEYRDSGSFTDEQLDKLQKILDDIRARGSYDKNLLKLEYLPFAYNLPRYKNLTTEALFDDDSVSGKKRVAEWREREKTREAEREQRRQR

SEQ ID NO: 190 - DNA, 30 bp, Artificial Sequence
  Direct repeat 1
gtgagaagtctccttatggggagatgctac

SEQ ID NO: 191 - DNA, 30 bp, Artificial Sequence
  Direct repeat 2
gtagcatctccccataaggagacttctcac

SEQ ID NO: 192 - DNA, 36 bp, Artificial Sequence
  Direct repeat 3
gctagggcttgtaggaattccttgctatggtacaat

SEQ ID NO: 193 - DNA, 36 bp, Artificial Sequence
  Direct repeat 4
attgtaccatagcaaggaattcctacaagccctagc

SEQ ID NO: 194 - protein, 116 aa, Artificial Sequence
  Gut_metagenome_contig6893000291
MYPFINFAIFRYYNVYHKEADYLVDSLRASMNEVEKDAVYRREAVRIWPRLKKLILNHILPEMTGSKIKEKDAKPDPEMDASMIDSVKIGTESTLFTKIIFLTTLFLNGKETNDLI

SEQ ID NO: 195 - protein, 30 aa, Artificial Sequence
  Cas13d motif
  misc_feature (2)..(6): Xaa can be any naturally occurring amino acid
  MISC_FEATURE (7)..(7): Xaa can be Phe, Trp, or Tyr
  misc_feature (8)..(10): Xaa can be any naturally occurring amino acid
  MISC_FEATURE (12)..(12): Xaa can be Asn, Gln, or Ser
  MISC_FEATURE (13)..(13): Xaa can be Ile, Leu, or Met
  MISC_FEATURE (14)..(14): Xaa can be Ile, Leu, Met, or Val
  misc_feature (15)..(16): Xaa can be any naturally occurring amino acid
  misc_feature (18)..(19): Xaa can be any naturally occurring amino acid
  MISC_FEATURE (20)..(20): Xaa can be Phe, Trp, or Tyr
  misc_feature (21)..(22): Xaa can be any naturally occurring amino acid
  MISC_FEATURE (23)..(23): Xaa can be Ala or Gly
  misc_feature (24)..(27): Xaa can be any naturally occurring amino acid
  MISC_FEATURE (28)..(28): Xaa can be Asp or Glu
  misc_feature (29)..(29): Xaa can be any naturally occurring amino acid
LXXXXXXXXXKXXXXXNXXXXXXXXXXXXD

SEQ ID NO: 196 - protein, 18 aa, Artificial Sequence
  Cas13d motif
  MISC_FEATURE (1)..(1): Xaa can be Phe, Trp, or Tyr
  MISC_FEATURE (2)..(2): Xaa can be Ile, Leu, or Val
  misc_feature (3)..(4): Xaa can be any naturally occurring amino acid
  MISC_FEATURE (5)..(5): Xaa can be Asn, Gln, or Ser
  MISC_FEATURE (6)..(6): Xaa can be Ile, Leu, or Val
  misc_feature (7)..(8): Xaa can be any naturally occurring amino acid
  MISC_FEATURE (9)..(9): Xaa can be Asp, Asn, Ser, or Thr
  misc_feature (10)..(11): Xaa can be any naturally occurring amino acid
  misc_feature (13)..(13): Xaa can be any naturally occurring amino acid
  misc_feature (15)..(16): Xaa can be any naturally occurring amino acid
  MISC_FEATURE (17)..(17): Xaa can be His, Lys, or Arg
  MISC_FEATURE (18)..(18): Xaa can be Phe, His, or Tyr
XXXXXXXXXXXFXYXXXX

SEQ ID NO: 197 - protein, 15 aa, Artificial Sequence
  Cas13d motif
  MISC_FEATURE (2)..(2): Xaa can be Cys, Asp, Asn, Ser, or Val
  misc_feature (3)..(4): Xaa can be any naturally occurring amino acid
  MISC_FEATURE (6)..(6): Xaa can be Phe, Trp, or Tyr
  misc_feature (7)..(7): Xaa can be any naturally occurring amino acid
  MISC_FEATURE (8)..(8): Xaa can be Ala, Asp, Asn, or Thr
  MISC_FEATURE (9)..(9): Xaa can be Leu or Met
  MISC_FEATURE (10)..(10): Xaa can be Ser or Thr
  misc_feature (11)..(14): Xaa can be any naturally occurring amino acid
  MISC_FEATURE (15)..(15): Xaa can be Phe, Trp, or Tyr
YXXXRXXXXXXXXXX

SEQ ID NO: 198 - protein, 940 aa, Artificial Sequence
  Ga0224415_10007274
MIEKKKSYAKGMGLKSTIVSGSKVYMTTFGDGSEARLEKVVENDSIKTLHEGEAFSAEMTDNNAGYKIGNVKFSHPNGYDVVANNPFYTGPVQQDMLGLKEILERRYFGSSTDGNNTICIQIIHNILDIEKILAEYITNAVYATNNIIDPDNDVIGGKKFTSIKTFAQFSASDSSNDFEQFLKNPRLGYLGKAFFYKDGKRNNRQKDPIECYHLLALLCGLRNWVVHNNEEKDLIKYTWLYNLDKYLDAEYITTLNYMYNDIGDELTDSFSKNSAANINYIAETLGIDPKTFAEQYFRFSIMKEQKNLGFNLTKLREVMLDRKDMSEIRENHNDFDSIRAKVYTMMDFVIYRYYIEEAAKVNAANKSLPDNEKSLSEKDIFVISLRGSFNEDQKDRLYYDEAQRLWSKVGKLMLKIKKFRGKDTRKYKNMGTPRIRRLIPEGRDISTFSKLMYALTMFLDGKEINDLLTTLINKFDNIQSFLKVMPLIGVNAKFAEEYSFFNNSEKIADELRLIKSFARMGEPVADARRAMYIDAIRILGTDLSDDELKALADSFSLDENGNKLGKGKHGMRNFIINNVITNKRFHYLIRYGNPVHLHEIAKNEAVVKFVLGRIADIQKKQGQNGKNQIDRYYETCIGKDSSKSVAEKVNALTKIITGMNYDQFDSRRNVIENTGAGNAEREKYKKIISLYLTVIYHILKNIVNINSRYVIGFHCVERDAQLYKEKGYDINLKKLKDKGFTSVTKLCAGIDEECKDVEKEMTERAKASFAALETANPKLYATYINYSDEEKNAELRKQINREKAKTALNAHLRNTKWNVIIREDLLRRDNKACKIFRNKVAHLEAIRYAHLYINDIAEVNSYFQFYHYIMQRRIMAERYDKSSGKVREYFDAVNNEKKYNDRLLKLLCVPFGYCIPRFKNLSIEALFDMNEAVKFDKEKK

SEQ ID NO: 199 - DNA, 36 bp, Artificial Sequence
  DR
caagtaaacccctaccaagtggtcggggtttgaaac

SEQ ID NO: 200 - protein, 1057 aa, Artificial Sequence
  EMG_10003641
MEETKVTKETTIEKQSTKRHKQKSKKTATKMSGLKSALVINNHEMLLTSFGKGNNAIAEKRYILDGDIETINNKNKKFDANNDSKVVVIKGISNPNGQLTNPLFDQSPTAIQPNRTSGNDMIGIRRMLERKYFVHNEENKEFQDNIRIQIAYCILDIEKILMPHINNICFEINNMLRLEGYQEDSFMGSFNLYKPYDAFIATTDDKESSRRDNFAKLMTSKQVRYLGNALYSDSLSNLTKDEILDGKRSKELKKYYQELCLLGMVRQSMIHSNQFNSSIYTLDSSYDSTMNTAELLGKGDDSSLVALATDARVEARAILDEIYKKGVDSINNSFLSNSINDLENLFKIYKCDSSEKKTELIKQYYDFCIRKPQMNMGFSITTIREGMFTRCSEANTLLLCDEGSTVKLNVHDTMKSKFYKNLDFMIYKYYKYENPEKGEKLIEDLRSKIKGKKKEDEDKKQRYAEESACILKAKRDIIKKDLTEAANKDLFADLVKSNKNEKQKFKNEYEELLKPFMIPVKVDYFSELIYLVTRFLSGKEINDLLTQLINKFENIAAFIRMYQNDQGKLEFTANYKMFEIDPQKDIPKDGKRVLSGSAKIAYYLRTINYIARMESFEIKSDKTAINDAISLLGYNSNEHRDEFITYTMAKHVVDKYQNTDYQKIVKDFLSANKTLDCKSKNMQAFVSELKNAHLSENYEQREKEIYELADTNLPAYFSEEDKEKLARYIVHSDGTYKKFLKESFYAIEELPNEGFRNFISNNVINSRRFNYIMRFCNPEKIANIGKNKVLISFALSSLAEKTDMIAKYYRVFCDRIDDQKTMEDYLVNKLTKISYTEFLNVNQKANAEKNKEKDRSQKLIGLYITLLYEIVKNLVNINSRYNIAFQRCDNDSIMILQGQYDERAVQESKLTKKFISNQKLNSYSCRYLTHNISQLDRCNDFIRQYRNKVAHLEVVSNIDEYLSGIKHIESYYALYHYLMQKCLLKNYRIEDHSQNEYKNLNDFSSKLDKHGTYVKDFVKALNVPFGYNLPRYKNLSIDELFDRNKLKTGGTIEMKGE

SEQ ID NO: 201 - DNA, 36 bp, Artificial Sequence
  DR
gaactacacccctgcagaaatgctggggtctgaaac

SEQ ID NO: 202 - protein, 973 aa, Artificial Sequence
  Ga0129306_1000735
MQKQREQQTVTDESERKKKPLKSGAKAAGLKSVFVLSEGKELLTSFGRGNEAVPEKRVTGGTIANARTDNKEAFSAALQNKRFEVFGRTAGSSDDPLAVSRAPGQDLIGAKTALEERYFGRAFADNIHMQVIYAIQDINKILAVHANNIVYTLNNLDREADPETDDFIGSGYLTLKNTFETYCDPAALNEREREKVTVSKQHFDAFMQNPRLAYYGNAFFRKLSKAERLARGREIFDKESPERRQEILGSRGKNKSVDDEIRALAPEWVKREERDVYSELVLMSELRQSCFHGQQKNSARIFRLDNDLGPGVDGARELLDRLYAEKINDLRSFDKTSASSNFRLLFNAYHADNEKKKELAQEFYRFSVLKVSKNTGFSIRTLREKIIEDHAAQYRDKIYDSMRKKLFSTFDFFLWRFYEEREDEAEELRACLRAARSDEEKEQIYAEAAASCWPSVKPFVESVAATLCDVVKGRTKLNKLKLSADESTLVRNAIDGVRISPRASYFTKLIYLMTLFLDGKEINDLLTTLIHAFENIDSFLSVLGSERLERTFDANYRIFADSGVIAQELRAVNSFARMTTEPFNSKLVMFEDAAQLFGMSGGLVEHAEELREYLDNKMLDKTKLRLLPDGKVDTGFRNFIISNVTESRRFRYLVRYCEPRAVRDYMSCRPLIRLTLRDMPDTILRRYYEQSVGAATVDRERILDTLADKLLSLRFTDFENVNQRANAERNREKQKMMGIISLYLNVAYQIVKNLVYVNARYTMAYHCAERDTELLLNAAGEGNLLRRDRSWPARLHLPRRALARRRDRVEVMERDVARGPEAYNRDEWLGLVRTLRREKRVCDNLHNNYAYLCGADAEPGDASLSLLFVYRNKAAHLSVLNKGGRLSGDLKEAKSWFYVYHFLMQRVLEEEFRNTQALPERLRELLMMAERYRGCSKDLIKVLNLTFAYNLPRYKNLSIDGRFDKNHPDPSDE

SEQ ID NO: 203 - DNA, 36 bp, Artificial Sequence
  DR
ccactacacccctgtcgaacaacgggggtctaaaac

SEQ ID NO: 204 - protein, 854 aa, Artificial Sequence
  Ga0129317_1008067
MKKQKKSLVKAAGLKSAFVVGDSVYLTSFGKGNAARLDTKINPDNSTERYVSDSEKHTLKINSITDTELRLSGPFPKQAEAKNPTHKKDNEQKNTRQDMLGLKSTLEKFYFGSTFDDNIHIQIIHNIQDIAKILAAHSNNAGYALDNMLAYQGVEFSDMIGYMGTSRTFDNYDPNHKNNKDFFRFLKLPRLGYFGSAFYSQKGKDFEKRSDEEVYNICALMGQIRQCCFHGKQEKYQLKWLYNFHNFKSNKPFLDTLDKHFDEMIDRINKNFIKNNTPDLIILSGLYPDMAKKELVRLFYDFTTVKEYKNMGFSVKKLREKMLESEEASDFRDKDYDSVRRKLYKLMDFCIYYLYYSDSERNENLVSRLRESLTDENKDIIYSKEAKIVWNELRKKFSTILDNVKGSNIKKLENVKEKFISEDEFDDIKLDIDISYFSKLMYVMCYFLDGKEINDLLTTLVSKFDNIGSIIEAATQIGINIEFIDDFKFFDRSKDISVELNIIRNFARMQAPVPNAKRAMQEDAIRILGGSEEDIFSILDDMTGYDKSGKKLAQSKKGFRNFIINNVVESSRFKYIVRYSNPQKIRKLANNSVVVGFVLGKLPDAQIESYFNSCLPNRVYSTPDKARESLRDMLHNISFNDFADVKQDDRRATPEEKVEKERYKAIIGLYLTVMYHLVKNLVYVNSRYVMAFHCLERDAMHYDVSLDNYRDLIRHLISEGDSSCNHFISHNRRMRDCIEENVKNSEQLIFGKEDAVIRFRNNVAHLSAIRNANEYIGDIREITSYFALYHYLMQRKLIDDCKVNDTAHKYFEQLTKYKTYVMDMVKALCSPFGYNLPRFKNLSIEGKFDMHESK

SEQ ID NO: 205 - DNA, 36 bp, Artificial Sequence
  DR
gaactacactactgtaattttgcagtagtctaaaac

SEQ ID NO: 206 - protein, 965 aa, Artificial Sequence
  Ga0224415_10048792
MSKKENRKSYVKGLGLKSTLVSDSKVYLTTFADGSNAKLEKCVENNKIICISNDKEAFAASIANKNVGYKIKNDEKFRHPKGYDIISNNPLLHNNSVQQDMLGLKNVLEKRYFGKSSGGDNNLCIQIIHNIIDIEKILSEYIPNVVYAFNNIAGFKDEHNNIIDIIGTQTYNSSYTYADFSKDKSDKKYIEFQKLLKNKRLGYWGKAFFTGQGNNAKVRQENQCFHIIALLISLRNWATHSNELDKHTKRTWLYKLDDTNILNAEYVKTLNYLYDTIADELTKSFSKNGAVNVNYLAKKYNIKDDLPGFSEQYFRFSIMKEQKNLGFNISKLRENMLDFKDMSVIRDDHNRYDKDRSKIYTMMDFVIYRYYIDNNNDSIDFINKLRSSIDEKSKEKLYNEEANRLWNKLKEYMLYIKEFNGKLASRTPDRDGNISEFVESLPKIHRLLPRGQKISNFSKLMYLLTMFLDGKEINDLLTTLINKFENIQGFLDIMPEINVNAKFEPEYVFFNKSHEIAGELKLIKGFAQMGEPAATLKLEMTADAIKILGTEKEDAELIKLAESLFKDENGKLLGNKQHGMRNFIGNNVIKSKRFHYLIRYGDPAHLHKIATNKNVVRFVLGRIADMQKKQGQKGKNQIDRYYEVCVGNKDIKKTIEEKIDALTDIIVNMNYDQFEKKKAVIENQNRGKTFEEKNKYKRDNAEREKFKKIISLYLTVIYHILKNIVNVNSRYILGFHCLERDKQLYIEKYNKDKLDGFVALTKFCLGDEERFEDLKAKAQASIQALETANPKLYAKYMNYSDEEKKEEFKKQLNRERVKNARNAYLKNIKNYIMIRLQLRDQTDSSGYLCGEFRDKVAHLEVARHAHEYIGNIKEVNSYFQLYHYIMQCRLYDVLKNNTKAEAMVKGKAKEYFEALEKEGTYNDKLLKIACVPFGYCIPRYKNLSMEELFDMNEEKKFKKKAPENT

SEQ ID NO: 207 - DNA, 36 bp, Artificial Sequence
  DR
caagtaaacccctaccaaatgtaaggggtttgaaac

SEQ ID NO: 208 - protein, 1022 aa, Artificial Sequence
  160582958 _gene49834
MKNSVTFKLIQAQENKEAARKKAKDIAEQARIAKRNGVVKKEENRINRIQIEIQTQKKSNTQNAYHLKSLAKAAGVKSVFAIGNDLLMTGFGPGNDATIEKRVFQNRAIETLSSPEQYSAEFQNKQFKIKGNIKVLNHSTQKMEEIQTELQDNYNRPHFDLLGCKNVLEQKYFGRTFSDNIHVQIAYNIMDIEKLLTPYINNIIYTLNELMRDNSKDDFFGCDSHFSVAYLYDELKAGYSDRLKTKPNLSKNIDRIWNNFCNYMNSDSGNTEARLAYFGELFYKPKETGDAKSDYKTHLSNNQKEEWELKSDKEVYNIFAILCDLRHFCTHGESITPSGKPFPYNLEKNLFPEAKQVLNSLFEEKAESLGAEAFGKTAGKTDVSILLKVFEKEQASQKEQQALLKEYYDFKVQKTYKNMGFSIKKLREAIMEIPDAAKFKDDLYSSLRHKLYGLFDFILVKHFLDTSDSENLQNNDIFRQLRACRCEEEKDQVYRSIAVKVWEKVKKKELNMFKQVVVIPSLSKDELKQMEMTKNTELLSSIETISTQASLFSEMIFMMTYLLDGKEINLLCTSLIEKFENIASFNEVLKSPQIGYETKYTEGYAFFKNADKTAKELRQVNNMARMTKPLGGVNTKCVMYNEAAKILGAKPMSKAELESVFNLDNHDYTYSPSGKKIPNKNFRNFIINNVITSRRFLYLIRYGNPEKIRKIAINPSIISFVLKQIPDEQIKRYYPPCIGKRTDDVTLMRDELGKMLQSVNFEQFSRVNNKQNAKQNPNGEKARLQACVRLYLTVPYLFIKNMVNINARYVLAFHCLERDHALCFNSRKLNDDSYNEMANKFQMVRKAKKEQYEKEYKCKKQETGTAHTKKIEKLNQQIAYIDKDIKNMHSYTCRNYRNLVAHLNVVSKLQNYVSELPNDYQITSYFSFYHYCMQLGLMEKVSSKNIPLVESLKNEANDAQSYSAKKTLEYFDLIEKNRTYCKDFLKALNAPFSYNLPRFKNLSIEALFDKNIVYEQADLKKE

SEQ ID NO: 209 - DNA, 36 bp, Artificial Sequence
  DR
gaactacacccctctgttcttgtaggggtctaacac

SEQ ID NO: 210 - protein, 998 aa, Artificial Sequence
  250twins_35838_GL0110300
MGNKQRVSAQKRRENAKLCNQQKARQAESQRDKIKNMNVEKMKNINTNDIKHTKTTAKKLGLKSTIIADKKIILTSFINEQSSKTANIEKVAGFKGDTIDTISYTPRMFRSEINPGEIVISKGDDLSEFANPANFPIGRDYVKIRSALEKQYFGKEFPEDNLHVQIAYNVADIKKILSVYINNIIYMFYNLARSEEYDIFYNSQSENSGRDCDVIGSLYYQASYRNQDANRFEKDGKKKAIDSLLDDTRAYYTYFDGLFSVPKREDDGKIKESEKEKAKDQNFDVLRLLSVGRQLTFHSDKSNNEAYLFDLSKLTRAAQDENRRQDIQSLLNILNSTCRSNLEGVNGDFVKHAKNNLYVLNQLYPSLKANDLIGEYYNFIVKKENRNIGIRLITVRELIIEHNYTNLKDSKYDTYRNKIYTVLNFILFREIQENSIAIKNFREKLRSTEKAEQPALYQAFANKIYPMVQAKFAKAIDLFEEQYKTKFKSEFKGGISIENMQQQNILLQTENIDYFSKYVLFLTKFLDGKEINELLCALINKFDNIADLLDISKQIGTPVVFCADYESLNDAAKIAENIRLIKNIAHLRPAIQEAQSSKDNADAAGTPATLLIDAYNMLNTDIQLVYGEAAYEELRKDLFERKNGTKYNKKGKKVDVYDHKFRNFLINNVIKSKWFFYIAKYVKPADCAKMMSNKKMIEFALRDLPETQIKRYYYTITGNEALGDAESLKGVIIEQLHAFSIKNTLLSIKNMGEGEYKIQQIGSSKEKLKAIVNLYLTVAYLLTKSLVKVNIRFSIAFGCLERDLVLQKKSEKKFDAIINEILLEDDKIRKECDKERAQAKTLPRELAQERFAQIKRRESGCYFKSYHVYDYLSKNSNEFKQNHIDFAVTSYRNNVEHLNVVHCMTKYFSEVKDVKSYYGVYCYIMQRMLCDELIIKNQDKPDVRQTFEEYNRLLKDHGTYSKNLMWLLNFPFAYNLARYKNLSNEDLFNAKNNDQKSK

SEQ ID NO: 211 - DNA, 36 bp, Artificial Sequence
  DR
gtacaatagcccgttgaaatagatgggttctaagac

SEQ ID NO: 212 - protein, 1020 aa, Artificial Sequence
  250twins_36050_GL0158985
MKKKHQSAAEKRQVKKLKNQEKAQKYASEPSPLQSDTAGVECSQKKTVVSHIASSKTLAKAMGLKSTLVMGDKLVITSFAASKAVGGAGYKSANIEKITDLQGRVIEEHERMFSADVGEKNIELSKNDCHTNVNNPVVTNIGKDYIGLKSRLEQEFFGKTFENDNLHVQLAYNILDIKKILGTYVNNIIYIFYNLNRAGTGRDERMYDDLIGTLYAYKPMEAQQTYLLKGDKDMRRFEEVKQLLQNTSAYYVYYGTLFEKVKAKSKKEQRAKEAEIDACTAHNYDVLRLLSLMRQLCMHSVAGTAFKLAESALFNIEDVLSADLKEILDEAFSGAVNKLNDGFVQHSGNNLYVLQQLYPNETIERIAEKYYRLTVRKEDLNMGVNIKKLRELIVGQYFPEVLDKEYDLSKNGDSVVTYRSKIYTVMNYILLYYLEDHDSSRESMVEALRQNREGDEGKEEIYRQFAKKVWNGVSGLFGVCLNLFKTEKRNKFRSKVALPDVSGAAYMLSSENIDYFVKMLFFVCKFLDGKEINELLCALINKFDNIADILDAAAQCGSSVWFVDSYRFFERSRRISAQIRIVKNIASKDFKKSKKDSDESYPEQLYLDALALLGDVISKYKQNRDGSVVIDDQGNAVLTEQYKRFRYEFFEEIKRDESGGIKYKKSGKPEYNHQRRNFILNNVLKSKWFFYVVKYNRPSSCRELMKNKEILRFVLRDIPDSQVRRYFKAVQGEEAYASAEAMRTRLVDALSQFSVTACLDEVGGMTDKEFASQRAVDSKEKLRAIIRLYLTVAYLITKSMVKVNTRFSIAFSVLERDYYLLIDGKKKSSDYTGEDMLALTRKFVGEDAGLYREWKEKNAEAKDKYFDKAERKKVLRQNDKMIRKMHFTPHSLNYVQKNLESVQSNGLAAVIKEYRNAVAHLNIINRLDEYIGSARADSYYSLYCYCLQMYLSKNFSVGYLINVQKQLEEHHTYMKDLMWLLNIPFAYNLARYKNLSNEKLFYDEEAAAEKADKAENERGE

SEQ ID NO: 213 - DNA, 36 bp, Artificial Sequence
  DR
gtacaatagccctgcagtaaggcagggttctaagac

SEQ ID NO: 214 - protein, 903 aa, Artificial Sequence
  31009_GL0034153
MGSRGVIIMTEKRKSRAKALGVKSAFLKDDDVIMTSFGRGNDAVVEKIIKNNEVQNINIDKPVYDVVGVEKETGIINVVGTKRGINTINKKKQYANTQVSQKRMGMDLIQRKDKLEKVFFNENFNDNIHIQLIYNILDIEKILSVYVNNIVYALGNLERDNSDDEKDLIGYASTLNSYEDFINKNLVKQNENIDKFIENGNRLGYFGNVFYKNKNELKDKKDIFDMLCLLGSLRQFCFHFKGAKFEGVEQISNSWLYNLSQLHNEFKSTLDSFYNEKIEDINGNFIEKNKVNIQILCNDLKLDKNKLVQDYYNFLISKNHKNMGFSIKKIREYILDIDYASYIKEQGYDSVRSKLFTLIDFIIYDLYVNKEKDRIDDIVSKLRGAIYDYKKDDIYKAEADWVWKKLNRQIKALTKLLSNRRIFSQDNDITNWNGVEFEKIGEQKLEDNADYFCKLMYFVTLFLDGKEINDLLTTLINKFDNIRSFIEVMEEMSLKCEFMEEYKFFNESKDICLRLKEIHSFARMKRPLDNKNVEKEMYKDAISILMKDSSIENSNIDVIFNTYIYQKDNKNAKKDFRNFIIKNVIKSNRFIYLIKYSNPTNVRKFASNTNVIKFVLGTLPDKQLERYYKSCGLSDGIGKTEWVRELSEIITGIDYSDFLNVKQRAKSKEEKEDKAKKQAIVTLYLTILYILTKNLVNVNSRYVIAVHCIERDSELYKTELYEKLKPEQPEKLYKIKPDKPLQPAQYFLFTKYLLQNDFFGEYTSKKNQYIQKNMKIYSKINKNFNVFVRYRNNIAHLNSIKNATKYVNDIGTFTSYFQLYHYIMQCDLKDWVKKEVEEKKISDKYYNYLEKYYKNNNIYLKDFVKAINVPFAYNYSRFKNLSIDKLFDKNDPRKKKWIVIFNF

SEQ ID NO: 215 - DNA, 36 bp, Artificial Sequence
  DR
gaactacacccttgttaaataacatgggtctaaaac

SEQ ID NO: 216 - protein, 951 aa, Artificial Sequence
  530373_GL0023589
MKTEMKNGEVKTSAKKENCSIAKANGLKSTFKLAENTYYMTSFGKNNTADPEKNIVRMNVENIRNTFSATPISERIVDITGETKKTAQVVLPACSDNQLHAKDTIEQMYFGKTYTDNIHIQIAYNIMDMKKIFGVYSNNIIYSINNLLEEREGSDFLGVFYTENSYQAMNFADAIIKSKLLTKNSKYLNLDMNNVWFNKEVSELSSFRKYVYSRSYANKTSTAKKICICLQEDFHFFDYATVKKAADQFTLLKRIQRSNYFFDMLCDSAGNYQCKNAQILLSILGNLRQESFHENRSTSAWMFNLEKVLTPERKKLLTALIDSRTNHINNHFIENSNKNLNAIFRLFPEKSQADLIVEYYDFSVRKAYKNLGFSVKLLREMLLKTQQELSPLNDKAYDSIRSKLYTMFDFVLYKLYVDNEEQIDQFVRKLRASTSNVEKEALYQQESERTWNEIRGQIIDNVIPFIDSIQKQENEDKLTKRIDQSIIDKAVPHFVNSRDLSYFAKVVYVVASFLDSKEINMFFDALINELENIASFNDVLEQLDMPLDYQEKYRFFERSREEAAGLRFIKSIAKMNKTRVAVKNDTKTVKLKQYCDAGAVLGEINAEKIKAAFGLGDKFNTEEARVDHTFRNFIINNVINSNRFNYVMRFMNPKSARRIMQCESLVAFSLKDIPDTQIERYCKSVNIPFDSANPNYAHMKEQLTYKLLQVQFCNFSKVSNSSHQAVEKERLKALVGLYLSVLYRIVKSIVRINTSYTIAFAAYERDCVILNRKMGKNLYGLKTDPMGITNDFMHMPTVAPSNPHNDFINETKLSKRVCALVNKNRTLCTNRTYQVYRNIIMHLNAVSAFPQYLEGLKVVHSYFDLYHYTVMMLLHRQNEKEKKRNEKEKKQNEKENNMILSTAALEKYDMVRKYQSANKDFIYAINSPLAYNAARYINLSCRTKFEEGFGK

SEQ ID NO: 217 - DNA, 36 bp, Artificial Sequence
  DR
acttaaatccccctgtaaatgcgggggttctaaaac

SEQ ID NO: 218 - protein, 928 aa, Artificial Sequence
  BMZ-11B_GL0037771
MSKDKKTKAKRMGVKALLAHGEDKLTMTTFGKGNRSKIEFTEGYHGRALETPKHFGKRGFEVRKIDENVDLYGDLEEGKTIEALLINPSEKVGEDYLKLKGTLEKRFFGREFPHDNIRIQLIYNILDIYKILGMNVADILYALGNMQDTELDIDMFGQSLNNPEKAKDVVQRMKPYMGFFGGIFRTQKKEDRKKDSNLSEEEKEEKKKKQEELLQKDLQHNMDVARCISALRHATAHNKPATAHDKQDEYPWFKSSDIYETKIFKAGMWSVIEADYKKKIQDVNKQFFSKNKVNLAILFDLLDVRDVKQKKRISDEFYRFTIRKDGKNLGMNLVKIREIIIDRYASGLRDKKHDPHRQKINVIADFLIFRALSQNQGIIDKTVSSLRLTKDEEEKDHVYQNAAELVWGMVSNCLTPYFNDPKNKYILKYKDAKTPGDFEDWITSKISEDDGEPFVKVLSFLCNFLEGKEINELLTAYIHKFECIQDFLNVISSLGENVQFQPRFALFNNASFAQNVAVQLRILASIGKMKPDLTEAKRPLYKAAIRMLCPPEKWEKYTSDEWLEKNMLLNSEDRKNDKKKKQVNPFRNFIAGNVIESRRFMYLVRYSKPKAVRAIMQNRSIVNYVLHRLPSEQIKTYSRVFPEDFSDTEAEIDFLVNKLSEFSFETFISNQQTILNNSKRGFSPNRRETAEEIERLKAITGLYLSVAYIAIKNIVKANARYYIAFAVFERDKELVKAKDARIQTTIPNTKFTNYFCLTQYYLDRDEEKKFPGDPRDKEAFFEHLRKTKRHFSKQWREWLNEKIADAKSSQATGLLLREARNDVEHLNVLRAIPDYIQDFRHGEKGETAMNSYFELYHYLMQRLMLKNTELDLSHWSGWIMRSGRPDRDLIQIAFVSLAYNLPRYRNLTKEHHFDDTVLQKIREKESLD

SEQ ID NO: 219 - DNA, 36 bp, Artificial Sequence
  DR
ggtcaacagtgtggggaattacccgcactctacaac

SEQ ID NO: 220 - protein, 940 aa, Artificial Sequence
  BMZ-11B_GL0037915
MAEHSKKTAAKRVGIKSVIAHDGGKLAVTTFGKKSAAKLAYRDGDQTPFDEEKKSELGGFNVTGVDENTVDAERGIPGEGLIEASVANPVNDLIDESRKEYGQDYLMLKDQLEKVFFGQTFPGDNLRIQIIYNILDMQKAFGLYVNDVLYAVNNLQNTGRLLTDDDWTSDVIGLALGKGRGKEIIESMSDALGFFGSAFKPIPKKPGDKTSGKYAGGKLKERDAAIAEDVAVLRVLCGLRQISAHFRSEKKGESLWASDLGVEKYFKNEMSVVDANYKARAKKIDANFMATSRANLVLLFRILNAKTKEEKEKIAVDYYKFAIRKEGKNLGVNLKKAREILLDKHYPDAKNKQFDSYRGKLYTITDFIIYRMAAEDGAFLEESVQKLRSTPSEEEKEKVYDVLAETIWNATKDDVKKVFDIRQQDIKNAAAQSLDDVNLDSVTVEKEKEFPVVKLLAFLCNFLDGKEINELLSTFVNRLENVQALIDLAKNLGETVNFSKNYAVFNDCGSGAAGRIAERLRLLASIGKMDAGLDSLKPLFIRFAIQILGGARISDEDVDAYIKENILVRKDDPEKKRSNTFRNFITNNVIKSRRFVYLVRYTKADAVRAVMKNGKIVRYVLARIPETQVDSYYKSVVDSSDAGNGKPIKEKIKALAEKLGEFSFDLIAENRDGIIDNAKLDEEKKNVEIERLKAVTGLYLTVAFIAIKNLVKANARYYIAYSAFERDSELLKEKLGEEEFYKLCIEFKNKKGETGYNNAFALLKYYIDRDEDIWRKEEATHRGRDENGKLDYDPDPRRKHYPKRRWLNILKDNLAEMERIDPTGMLAAQMRNDAMHLNAMFKIAKFVGDFRKGSSHEMRSYFELFHFLEQKTLLDSKEDFVQGMRESYGDRIRVEPCVDLIKYLYITLGYSLPRYKTMTVSGLFDPDSEDAKERAKGKRA

SEQ ID NO: 221 - DNA, 36 bp, Artificial Sequence; identical to SEQ ID NO: 219
  DR

SEQ ID NO: 222 - protein, 923 aa, Artificial Sequence
  BMZ-11B_GL0069617
MPHNKKSTIKRIGVKSAFSHGNSRLTITQFGRGNTADIAVETDSRGRSLSLPHRVEKSFTVNKIDDEIDVQRSSLLGTLLNPAENDPVDYLGLKSTLEKEFFGQEFPNDSIRIQIIHNILDIQKILGIYINDVLYSIANLQNVETVEDCLGQSLSKGQDEKLKKILNSITPYLGFLGAGFKQSERPKHQKNSRPDPRQKIEDPNWAYNKSALRILSTLRNKLAHFEDSSILFCDNLKGQFLGSNGNWITIETHYDEMITRINESFFNNSRMNLKILYLVLNAATLEDKKKITEEYYRFSILKEGKNLGVNMRKLREMMVDMFYSEIKDKQYDSYRQKIYTILDFLLFREIKDSEELETMVADLRESESDEKKEELYHDYAELFWDGVKDLIVPFFAAFDGDFTVFTTEKVPADTSKEPFLSSANTEPLVKLLAFLCNFWDGKEVNEVLSAYIHKFESIQAFIDVLESKELNEKVVFSAKKGRNFSAFNEHGFAGRVADQLRVLASIGKMKPDLEGAKRALFRDAVETLGIVENSNWLNEDGTISNDWLETYVLPGDKVTEEEKRAIKPFRNFIANNVIESRRFMYLARYAKPKSVRELMKHEEIIRYVLTRLPEKQIDTYFSNISEGDESEISRKIDTLTKALTGFSFNSLFINRDKIVENTKLDTSNKNVKIERLKALTGLYLTVAFVAVKNLVKANARYFIAFSAFERDYGFMKSHDPDVAQSCLAYEEIMDGKSKTKYNEIYALTEYYLKKEEENDYHPEPGQPFDKEACRKHLDSIRRHFTKKWRDIFRKEIDEAVKIHFTGYLGVWARNQSAHLNVLTQALPQFIGQFARNSKTGKTARMTSYFQLYHYLLQRLLCEDLNFDVPEEWKNKIQETGLPCNDLIHICFVPLGYNLPRYKNLTIECLFDEDSVSAKEGKKA

SEQ ID NO: 223 - DNA, 36 bp, Artificial Sequence
  DR
atacagcagccctacagattcgtagggttctgtgac

SEQ ID NO: 224 - protein, 993 aa, Artificial Sequence
  DLF014_GL0011914
MAKKKNAKQRREEEKNRLKAKIEKFKIKYAEQETVDKITEEIAQSDKIMRTESILVQHTKKSLAKASGVKSVFIKDDEVIMTSFGRGNDAVVEKIIKDNNVDEKNTKPAYEIVDIEKNGDLIKVQSRRCKNIESANTELPPEKIGMDLIRCKDKLEEIYFGRTFNDNIHIQLIYNILDIEKILSVYINNAVYALGNLERKENDKEKDLVGYLSARAGYNKVINKAINDEKIKDRIEDLKEFIENGNRLGYFGDIFFKKEEVSKNGKKPKKVEVLKSEKEIFDILALLGSLRQFCFHYDEAVFENEDGVIDKEYNDNSWLYNLEKLEPEFKDTLDYFYNRKINDINKGFIKTNQINLHIICDELGLNWDKEQVVGDYYDFLIAKKYKNIGFSIKKIREHMFDIYEAFDIKDKRFDSVRSIMYKIIDFVIYYSFIHYKQDEVDEIVNYLRSTLSEEQKKEKYIKLAGNIWAEYKTQFNKLKDILLANIKEFSDAKEDDVYYEEFKNFKFNEVGKEKLGENAEYFCKLMYLLTLFLDGKEINDLLTTLINKFDNIRSFVELMKEENIECIFDKKFAFFDESKNVCSTLREINSFARMQKPLNNVSVKREMYKDAIKILLKDTRAEEQNIDRILNEYIPSKEDKGIKKDFRNFIIKNIIKSNRFMYLVKYSNPTDVRNLASNRNVVKFVLNAIPDTQIDRYYKSCIQHYSNEVDKETQIQELTDIITGIDYLDFLDVRQSYRNEDKSKKQAVVTLYLTILYILTKNLVNVNSRYVIALHCLERDSKLYGYTKLSKKNNKKLEKIKPPKYHELTKYFIDNRYFDRKKKNKKYGEYTSKKISTYIETNMKNFIGCEQFRTPERYRDTQIDMFVKYRNSIAHLNAVRKASKYINDIRGFDTYFELYHYIMQRDLKDILEKIAEGAAKETEEGQKQDELLKTYFDNLDKYGTYVKDFVKALNIPFAYNYPRYKNLSIDELFDKNNTRKTIKIQDKKLEERT

SEQ ID NO: 225 - DNA, 36 bp, Artificial Sequence
  DR
gaactactacctcacagatttgtggggttcagaaac

SEQ ID NO: 226 - protein, 924 aa, Artificial Sequence
  EYZ-362B_GL0088915
MKKKLNIREQREAKKAAAKQIYAAKASAAQKKADETVVAAQPAGDTANSKPIKSRNKAAGLKSTFVVGDSLYMTSFGKGNLSVPEYRVDTGDAYRVDPISEHSELHVLGADDLAVSFSGTRRMKDVSELKADNPLHSGKNNLVPKNGTDILGLKGILEQRYYGRNFDDNVHIQIIYNILDIEKNLAIYVTNVVAALDHMCDETLDTEHEDFIGYMNTMNSFDVFMHPSQSSRADIYKKINDSRRRFENLLRTKRLGYFGFAYNPKDRNQKKRLYYLMSMIGQLRQFAFHKDSPFNRVWLYQLDEKLSKEHKDTLNYFFDQRYDEIHENFNKTNKVNLELLAEAFPSEDYATLANQYYDFTVFKAHKNLGFSIKKLREKLIENALRDEKIDSFRSKLYRLIDFCLFRIYLKDPDRAEKNVRFLRSCINEQEKEQFYTQEANALKSENPGLVNDFCMQLKDRYSSGSNSTENAEKKEDFPVFPHCHDKQKVSNVSLFAKLMYAFCLFLDGKEINELLSALLNKFDTIACMTKCTKDLGIYAPFSKDFNFFEDSEQRAEEMNLVKSIARMTKPDIQAKEQLFRDALDILGVEVGVSEEALQKEIHQYFQKGAKHDFRNFIINNVINSTRFIYVIKFCNPKTAGQIIRNENILRFVLQRMPQEQIERYYHACTKNPSLCTHDEKIQCLSNIIMEVRYKKFCNVAQKSRDTTKQMEKERFKAIIRLYLTAIYLVVKNLVNVNARYVLAFHCLERDADLFGLQIKQTLPDRKKKSDYLKLAVDQCGDNPENKPKGYLARNKRLCQCVREDIDNAKHLNGDITDYRNCVAHLNVVRNCDQYLENIDTVHSYFSLYQYLVQHYLLKRFEKDKYRCKDDLAIHYYSQVKQYRSYVKDLVKALNAPFGYNIPRFKNLTVEQLFDRNADPETITA

SEQ ID NO: 227 - DNA, 36 bp, Artificial Sequence
  DR1
gaactatagtagtgtgaatttacactactctaaaac

SEQ ID NO: 228 - DNA, 36 bp, Artificial Sequence; identical to SEQ ID NO: 130
  DR2

SEQ ID NO: 229 - protein, 1054 aa, Artificial Sequence
  Ga0099364_10024192
MSQSTKTKAKRMGVKSVLAHGKDEKGHIKLAITAFGKGNKAELAIQTDEKGSNLAKTYKERNITANKIVSEGIQTSGTIAGEGHATFLNNPAEHVGTDYLKLKETLEMEFFGKSFPGDSVRIQIIHQILDIQKLLGIYITDIIYCINNLRDETHLDHESDIVGLSMSNTNVNLALNQMRPYFGFFGEAFRPVGDDKVKEITLSDEVRKNIEKIIALEEQKRNPSTPRFKQENINLEIENAMGKFKSKDAFETAKKKYNRIVADETNAKTLRILGAMRQITAHFKDQATLFMSDVELPKILKKEFSKADWQTVEDYYAKLVDRINEGFCKNAATNVHFLTELLPEESKKQLTEDYFRFAILKEGKNLGVNMKRLREVMFALFVPELTAPETKKRYDSYRAKIYGLTDFLLFKHIHNTKQLEEWVAVLRETSNEDAKENLYDEFARTAWNTVGDSAKQLIENMQSYFTKKEKEITKTAQPVLSTSSIAHTSKKITQFSSFAKLLAFLCNFWEGKEINELLSAYIHKFENIQEFINLLEKLEGKKPQFTENYALFNEAAGQRAGEIAQNLRILASIGKMKPDLGDAKRQLYKAAIEMLGIDTEEYISDEWLEPNMLLAQPPKEPKKDNEKYRKEPHKYSYEKDMETYRKKLREYEETWRSLIDYEYLMPETNPFRNFVAKQVIESRRFMYLVRYTKPKTVRALMSNRAIVHYVLSRIADIQDHHMTESQIDRYYQNLPQYNEQQHKNVSLETKIDALADYLCKYTFEKNVLKQKNGIVLNTKSATKNVEIEHLKALTGLYLTVAYIAVKNLVKANARYYIAFSIFERDYALFEKKLGKDTLEKYVKPFKYIDKGEEKEGKNNFFALTEYLLDKDNSLRYQWNNDLSDEENKQALRKHLDKKEIRSQRHFSQYWLDIFARQIENAKKTSESGYLLTAARNCALHLNVLTALPEFVGEFRKTGDKMTSYFELYHFLLQKLMLAEAGLNLDEYRERIDTYQTACKDLINITYVSLGYNLPRYKNLTCEPLFDEESATGKERQTRLDEKSKEKKQRKGGQK

SEQ ID NO: 230 - DNA, 36 bp, Artificial Sequence
  DR
gtgcagtagccttacagattcgtagggttctgagac

SEQ ID NO: 231 - protein, 971 aa, Artificial Sequence
  Ga0187910_10006931
MIEKKKSYAKGMGLKSTLVSDSKVYMTSFGNGNDARLEKVVENNAISCLVDKKEAFVAEITDKNAGYKIINKKFGHPKGYDVVANNPLYTGPVQQDMLGLKETLEKRYFGSSVSGNDNICIQVIHNILDIEKILAEYITNAAYAVNNIAGLDKDIIGFGKFSTVYTFDEFAEPDRHKERFIKDGKLDTKLINQLKNQYDEFDAFLDDTRFGYFGKAFFCKEGDKYLNKQDNERYHILALLSGLRNWVVHNNEVESKIDRKWLYNLDKNLDKEYITTLDYMYSDIADELTKSFSKNSAANVNYIAEILNIDSKTFAEQYFRFSIMKEQKNLGFTLTKLRECMLDREELSDIRDNHKVFDSIRSKLYTMMDFVIYRYYIEEAKKIENENKTLSDDKKKLSEKDIFIISLRGSFSEEQKDKLYSDEAERLWAKLGKLMLEIKKFRGQMTRDYKKSDTPTLNRILPESEDVSTFSKLMYALTMFLDGKEINELLTTLINKFDNIQSMLKIMPLIGVNAKFSSDYAFFNNSEKIADELKLIKSFARMGEPVANAKRDMMIDAIKILGTDLDDNEIKKLADSFFKDSNGKLLHKGKHGMRNFIINNVVNNKRFHYIIRYGDPAHLHEIAKNEVVVRFVLGRIADIQKKQGKGGKNQIDRYYEICIGNGYGKSVSEKIDALTKVIINMNYDQFEAKRKVIENTGRDNAEREKYKKIISLYLTVIYQILKNLVNVNSRYVIGFHCVERDAQLYKEKGYDINTNNLESKGFTSVTKLCVGIADDDPVKYKNVEIELKERALASFDALEKENPELYEKYNMYSEKQKEAELEKQINREKAKTALNAHLRNTKWNVIIRENIRNTEKDACKQFRNKADHLEVARYAYKYINDISEVNSYFQLYHYIMQRIIIDSSGNNANGMIKKYYESVISDKKYNDRLLKLLCVPFGYCIPRFKNLSIEALFDKNEAAKYDKIKKKVAVR

SEQ ID NO: 232 - DNA, 36 bp, Artificial Sequence
  DR
catgtaaacccctaacaaatggtaggggtttgaaac

SEQ ID NO: 233 - protein, 1105 aa, Artificial Sequence
  Ga0187910_10015336
MENVKNPKEIVKGAKVRFEIYENPKPKKQNQRFSAINVEVITDETHKEAKIQKNEFKTFDQFTKELQETQKVNGETKKEHITKNKHTNVKAAGVKSVFAVDDGNVLITSFGRGNAADIETLKSDDDKTINLTETENQKKYVVTNKRSNVKGLADNPTKVESIIPGETQIGFKSILEKHFFGRTFNDNIHIQIIHNILDIKKILAVHTNNIVYALDNIHERGRENSAEKPIDMIGAGGISTSKEYEQYCSEKSDYEDNFLKQLINNERIAYFGNAFFKDEGNKKVMRTEKEIYYILGMLNEVRNVSTHFTEEDNRDWAKANLYNLSNRLKVGSKEVLNQLYKEKIDKIDANGFVNKGCKRDFSILFKSLNLTTDKDKGELVVGFYDFSIRKNYKNIGFSIKTLREYMLKISNSTLCADTISNNAIRPKAYKLYDFIIWHYYMNKPDKINDFVEKLRTQNKNDEKIKLYYDEAVCLLSELGREIHTMTSCVHNIENTSYEITDKKQKEYYKMQINSLNSADKVSDFSKVIYLVTLFLDGKEINDLLTTLINKFDNIASLLSVLEKQSGKKVEFVENYSFFNSSNLLKEKTLNKSENYTCKIVEELREINSFARMTGDCKIRKSAFEDASQLLGYHDKTVNNLFEVLRLKELESKDWKKRTDDEQQEYDRLLNKHHYFKSGKKLPDTGLRNFIINNVIESRRFNYIVRYADPKKIRKCTENNELLKFAFKDVPDSQVDRYYNICVTNKITNATREEKIERLVDIIKSMNLSKVATVKQRDKQDNVEKQKQLAIMSLYLNILYQIAKNLVYVNSRYVMAFHSLERDSQMLFDAYYDVKRGYCDLSTVLLFGVDDLQNRNRGSYKYLRDNRRSNKDVIETFGDFKGKVSKVVEKKNQGLTNEIYDSLCNVAGTTKTEVQNEIKSILKSNGLDESASSYLSHKLVNKVHSYKYLKQNLDCADNTMINQFRNNVAHLNTIRNMDGIENVTGITSYFQIYHYLMQKALYKEFKKCRENAVRKWIPYITENAEPKYVYWNKKEQQEVEVSFNPKIFGYMENIKNHSNTYCKDFVKALCAPFAYNLPRFKNLSIEELFDMHELSEEPKESMKLTD

SEQ ID NO: 234 - DNA, 36 bp, Artificial Sequence
  DR
gaacgacgtcactacacaccgagaggtgtctaaaac

SEQ ID NO: 235 - protein, 927 aa, Artificial Sequence
  Ga0187910_10040531
MAKKKKAKQRREEQEAARMNKIQSAVKAKAETAPAVSSAFVEKRKDKQSKKTFAKASGLKSTLAVDNSAVMTVFGRGNEAKLDHRINADLQSESLHPQAALKNVHAPNKQKIHFIGRMQDMNLTADHPLHSHDGERAVGADLLCAKDKLEQLYFGRTFNDNIHIQLIYQILDIQKILALHANNIIFALDNLLHKKNDELSDDFVGMGRMRATIGYDAFRNSTNQKVQETYREFQEFVRRKELLYFGSAFYNGDTRRDEKVIYHILSLAASVRQFCFHNDYTSDDGKGFIKADWMYRLEEALPAEYKDTLDALYLEGVEGLDQSFLKNNTVNIQILCSIFNHDDPNKIAEEYYGFLMTKEYKNMGFSIKKLRECMLELPELSGYKEDQYNSVRSKLYKLFDFIIAHYFRKHPEKGEEMVDCLRLCMTEDEKDSHYEGTAKKLVRELAYDMQEAAEQANGSNITQMQKNEQQGKTKGMFAIRDEIRVSRKPVSYFSKVIYVMTLLLDGKEINDLLTTLINKFENIVSFEDVLRQLNVDCTFKPEFAFFGYDRCRNISGELRLINSFARMQKPSAKAKHVMYRDALRILGLDNGMSEEALDQEVRRILQIGADGKPIKNANKGFRNFIASNVIESSRFRYLVRYNNPHKTRMIAQNEAIVRFVLSEIPDEQIRRYYDVCRDPKLPRSSSREAQVDILTGIITDVNYRIFEDVPQSKKINKDRPDANDRMTLKKQRYQAIVSLYLTVMYLVTKNLVYVNSRYVMAFHALERDAYLYGITNIKGDYRKLTDNLLADENYKKFGHFKNKKWRGIAEQNLRNSDVPVIKSFRNMAAHISVIRNIDLYIGDIQKVDSYFALYHFLMQKLIQRVVPENTKGLSDQTKKYYDALEQYNTYCKDFVKAYCTPFAYVTPRYKNLTIDGLFDRNRPGEDK

SEQ ID NO: 236 - DNA, 36 bp, Artificial Sequence
  DR
caactactaccctgccaaatggcagggttcagaaac

SEQ ID NO: 237 - protein, 900 aa, Artificial Sequence
  Ga0187911_10069260
MSTKKRFRYSVAAKAAGLKSSLAVDTDRTVMTSFGHGNAAILEKEIVDGEISVLNIENPAFDAVINDKKYALTGHHAGVHALVDQPQNRSDAVHIRGALEKKYFGDTFADNIHVQIAYNILDITKILTVYANNVVYALNNLVHADDDTQADELDSLGNFSAGTSYAKSKSKSKSKQQDFVELFIKKKEIHGYFGDTFAFLDKRIADADKEKQVYAMLACLGSLRQACSHYRIRYSVNGKNVDADADTWLFSSAQLDQTDPLFSEMLNRIYSHKIKTVNQNFFENNRKANFPILKKMYPETTLKVLMNEYYDFSIRKGYKNFGFSIKSLREALLSPQYESLIGVQIKDNKEYDTVRSKLYQLFDFALTRYFNQHPDMVDAFVVELRSLAKDEDAKNAVYEKYAKAVWNDVKQPIAVMLSYMNGSAIKNIKAFELKPDQKELNGIMNSNALDVPHFCKLVYFLTRFLDGKEINDLLTTLVNKFDNIHSFNQVLTALGLSASYEADYKIFEDSGRVVEYLREINSFARMTVDMEKIKRSAYKKALLILGSSKYSDEDLDARVDEMLGVDYNQNGEKIKVRVDTGFRNFIANNVVESSRFHYLIRYCHPRKIRNLAGNAALIEYQLRRLPELQILRYYEACTEPIKRTARTMDEKIGTLIDLIVKMDFSQFEDVQQNDRVRVFSDAEKKEKIRKMREKQRYQSIISLYLTMLYLIVKNLVNINARYVMAFQAWERDNYLLLQLSGKEAEAEYLNLTRHFIEPLDGAKPYLKKRPVEYLKKDMAMVGNSSIRHFRNATVHLNVIMEAHRYTKDIKYIGSYYALYHYILQRHLLDKIEEDSYAEKTVSEKLWESQISQYGTYSKDFVKALCCPFGYNLPRFKNLSIEQLFDRNESKEITDATAPRQ

SEQ ID NO: 238 - DNA, 36 bp, Artificial Sequence
  DR
gaactacagccctgtgaaataacggggttctaaaac

SEQ ID NO: 239 - protein, 991 aa, Artificial Sequence
  MH0288_GL0082219
MKKMTAKERREQEKQKRAEVIRGKQEANRKKAQAAATQDATAPVHHKNAKSLAKAAGLKSTFTLPTGELLMTSFGRGSEALIQKRIMKDVISDVQEGDPAFSVIPMPKQFEIQGRAIDVQKEGSSVPEVLTDDPRASQKPAGADLIGAKPALEKRYFGKTFTDNIHIQLIYRILDIKKVLAIHANNIVYTLDNLSRREGTEGTDFIGIGGLTLKNSYAAYCEPRTFFDEGKEKNIIENIEKSHGEFLEYMKNPRLAYYGEAFYRRLSNNERSKLGMERYERMSDAQRDAFDRKYPIDFCDGELHFREIEKLAPEYVRKSEKEIYYILAMLSELRQCVFHDSAASRSWLYNLEKVLPAEAMQVLDGVYSQKVAALNNFSKTSSKSNFRLLFNALHADTDAQKKQIAEDFYKFSVRKTYKNIGFSIKLLRESMLDTFAPEYKEKSYDSVRGKLYQLVDFLIWNIYDKNEKMADALVAQLRAEVKRDRDEKSPVYDREAARLWTMIREAVAQTAKTLRAVTLSNNTPGSIKIKELALSKYDRDLVENAIDSAVDERGRRLKITDEASYFSKLIYLLTLFLDGKEINDLITTLVNSFDEIDSFCCVLQKAKLDRGFTEGYRFFAHSAEISQELRAINSFARMTTETVQGKPCMFEDAADLLGMDTDLEEVREALEAFYNKEKMSLKWTKDGQEADTGFRNFIISNVLKSSRFRYVVRYGNPKKLREVMQNEAVVKFVLNDLPEEQINRYSENILGLDAAAKEKKVSELARFLRALSLEDFRDVEQSANAARNARKARYQGAMSLYLNVIYQIIKNMVYINSRYTLAFAKYEHDASLLLDNWVYDPYKTVFSDLTEDSLQKGKLNRRAAKYLQTNLEHSDNTLIRQYRNSVAHLNAVRNMNLYIGDLREITSYFGIYHYIMQRDLITRCQKVKMKNPVVVGYFDKVRTYRTCCKDLVKALNITFGYNLPRYKNLSIEGLFDKNRPGDKKESALIAE

SEQ ID NO: 240 - DNA, 36 bp, Artificial Sequence; identical to SEQ ID NO: 203
  DR

SEQ ID NO: 241 - protein, 925 aa, Artificial Sequence
  O2.UC29-0_GL0096317
MERQKRRKKSCAKMAGVKSTFVIDSDLLMTSFGERDKAVREKYIAQGNVKSLRKQEQAFDAQYGKEKIFVTNADNKLHVAINNPLCGNKKQSPEAQEYSRRVLEHKKAINQKYETIVFGKPSNDNIHIQVVSKIMDIEKTFSFVMGNIVYAINNLDPEQNIDNPIDYMSNKARTDENLKRVLRRCMYLFDLGFEYAEPSPYKKSEQQIEQEREEREKENLETLKKALDVISVMRTDSFHGYDMCNSTSAIVKFPSKKFNLDQKGKNLIYRNAFKYKTDTIKKQYAQNSKVNINFLSYVLYGNGCTEEQKKELSREYFNFAILKQYKNLGFSITSLREQLLSLYDIDFECKRNLRSRANSFCDYVLYYRYAVQFPERIVDLVDKLRCSANEKEKTNVYIEEANRIKEDLRIAFNRINNFDAKSIKLYSTKNNVDDQPMLPFEQVSKDIKGGDAAREKADAFCDMTYYLTQFLDGKEINVFLTTLHNLFENIASFLDVMHKQNISYDFTEQYVMFYDSAYIVKKLETVISVSRMKKALDFYNGQALRDAIRVLGISERHVDMDMKEYVDKYLFDDCKDVKHADHNLRNFIVTNVIKSRKFNYLARYSDMATVSKLSKNKEVVKFVLKRVDPKQIERYYRSVCDVRNISAEDEIEKLVDIIYNFNIDELEQVNNAEIGTGHSGRKVASKRSVQERNQARACVSLYLNVLYQIVKNLMNVNSRYSIAFAMTERDMIVEGKGIEAIETFKDDPDAGKKSKKQIAYRTKYIALTEEYLDKGYIKCATERIKENIKKYGGDPKSIDHIPGEYIKKNLEGYCAGSTNTFRNAVAHLALMARVSEYASDIKNVNSYFSLYHYCMQKHILYCARRFNKQGNEKMAAALNDAEIHRSYSKDAVKFLCLPFAYNLPRYKALTVEGLFDWNEYGQDDD

SEQ ID NO: 242 - DNA, 36 bp, Artificial Sequence
  DR
gtactaagaccttactaaatggtaaggttccaaaac

SEQ ID NO: 243 - protein, 954 aa, Artificial Sequence
  PIG-014_GL0226364
MTKPEKKQIKQATLTKRMGLKSTLVFDNKITVTSFANSSNSEKASAHIEKRTDFWGKTIMQDEKMFRTDVEKQQIYIEKEFPDENNKIITQTAMFENPALRNCGKDYIGMKNSVEKVMFGKEFPNDNLHIQIAYNILDIKKIICPYINNVVNIFYNLGRGKLKDDKNDLLGKQIGPKSEEMVEDLLKNSSAYFVYFGDVFKQVKLSKEQQEKSEEEKRRIWQELWNKNFDHNKNIVNSLIKFRQMCFHQNYENSDKEVSSTALFNIEQFLNKEEKASLDEIYTGAIDKVNCDFNKNSSNNLYILEQIYCNDKNLGQRYYDFVVKKSQCNLGLDTKLIRELLIRKLSDEGLDINDSRYDTYRNKIYTVFGFILYYELTKNETFCQEIVAKLRRFGGDEIEKNKIYNEYFLRKEAVYNQIAEKFKQSVCWFKKEKEKKKEFSSKTKIDLRSVQKIEDQNASVFAKMVYLISRFLDGKEINELCTKLLNKFKNINELVETAKRCGETIEFCPEYKMFKNSAKLAEEMRFVQSVSKMKKLTKKEDKSIKPQVIDDALELLGLKIEKYKKDDQGNFVLDDQNHNVWTDEYKSYRKECFTPKNSDSMNDAEKSFVAKGHQKRNFIISNVVLNKRFLYVAKYGSPTACNQMMKNQKIVRMALESISEDQLRKYARRVYDNKEHFQNQTADEIRENLAKKLKNFNIGAELKTVGNLSEKDFRSSKNALKDKSKSLIGLYLTVAYLITKNMIKINTRFSIAFGAYERDMEFLLQQKKEKGKRFDWLALTQKFLSEDKNYYFEHDLRRKEINKISDRDERKKQHRENDKYYDSCMHFSRHSFEYISKNFAEVQSHPDPLKLFIKYRNNVMHLNIIRDLNDYLPDFKRGKAFEKTDTFYDLYCYCLQKMLLSEVDGFSAINENIDKYCTASKDFMNLLNIIFAYNVPRYKNLSNKELFYRLDSEQ

SEQ ID NO: 244 - DNA, 36 bp, Artificial Sequence
  DR
gtacaaaagccctccagtttggacgggttctaagac

SEQ ID NO: 245 - protein, 941 aa, Artificial Sequence
  PIG-018_GL0023397
MAKKLSPRELREQRERERQAKFAKQVQEREAEKAKREKQVSVSDTVGAAAAVQNENGKKSMAKAAGVKSVFAVGDTVYMTSFGRGNDAVLEKKIVDESHESLNKANPAYEITDISSVNYSVEGHRGQSVCATADNPLHHDGGSSVPTDMLCLKPTLERVYFGKTFDDNLHIQLIYNILDIEKILAIYSTNAVYALNNMIADEDDESSDLFQNMTTDYTYDKFRGRSERIVKSFNDFVSNPRLAYYSDAFYEKKGKGSKRRSEKEIYSMLAMLGKLRHWCVHSESGEAEFWLYKLDSLNGEFIDVLNTLYNRSVNEINRGFVDTNKVNIQILQAVCKNMDLISLIKAYYEFLITKKYKNMGFSIKKLREMMLAETAYTSNPDDRLYDKEINSVRNKLYQMTDFIIYLEYRDNKSIIDTLVSKLRSSVTDEAKEAVYREEAANLRGRLLDAVALIAKSLNGVNIKKLQQNTLEIPDSKLENCFIKSAEKVSAFTKLNYLLTRFINGKEINDLLTTLINKFDNIRSFLETMDELGLERTFTENYRFFEDSQKYRDELIELNSFAKSCSFDISAKRIMYRDALDILGIQAELSEDEIGRMIDNILQLDANGERISKNQRENGLRNFIASNVIDSNRFKYLVRYGNPKKIRETAKCPPAVKFVLDGIPDSQIERYYNSCFPEDTAICSADKKRRELAEMISNISFDWFKDAGNVQRVNAEDKSRNAEIKRKNQAIIRLYLTVMYLMLKNLVNVNSRYVIGFHCVERDAKLYKLSGLTIEGNTDKNRTLLTATILGITSADRAPSGEIVADCDLGRAETAANRHLRKKRWYVQIFNNLKQADRNVINEFRNSVCHLNAIRNINTNIEGIGFVKNYFALYHYLIQRHISSKRISFNSFSAEYISNLEKYHTPSEYFIKAYCTPFAYNLVRYKNLTIDGLFDRNAPSEK

SEQ ID NO: 246 - DNA, 36 bp, Artificial Sequence
  DR
gaactacacccctgttaaattgcaggggtctaaaac

SEQ ID NO: 247 - protein, 948 aa, Artificial Sequence
  PIG-025_GL0099734
MAKKMNAKEQRAAIQAEKNKKIQMANAAREKQAEEARLKAEAERIEKEENKKREAELKRFKLDQETRGKLPKNERKSLAKAAGLKSTFAVGTDLYMTSFGKGNDAIVEKKISNKQVTQINTEKENFTVDTDGITDTIVPVQSKRIACLNTQADNPLYRKDSENQVQPDKLLLKDTLEKVYFGKTFNDTLHIQLIYNILDIQKILTVYSVNTVYTLNNLFGKEISERGDFIGALSFQQTYDDYTSDSKNKEIFEDFYSKRSLGYYGHIFFKDKKKRSKREIYDILALIATIRQWCIHSEEDKKTWIYNAENVLDSEYLDILDDVYGGLVEKINKNFIKDNKVNLILLSDILDMKSKDDFEELIRQYYRFIITKEQKLLGFSITKIREAMLEDTVFKTDKKYDSIRSKLYKLIDFMMFYKYTTVDSEKEHADSIVEKLRATLSGESKEEIYKAEANRIWNLYEDIIMNKIEPALDEGVISGLKKNKSYDNMSIEGIVAEETANVSYFSKIIYLLAQFIDGKEVNDLTTTLINKFDNIRSFIDTANQIGLECNLLDEYQFFNTSDTVKKELHVIKNLTGMGYYDVSIKHQMYKDAIDILGLHDNLSDEEINQLIDTNILFIGADGKPVKMAKGKRGFRNFIISNVLKSSRFRYLVKYCNPKKIRKIANNEKIVKFVLGRITETQIERYYYSCNPELKRAAYPGREAAIDDLTKIIINMKFDDFKNVKQSANVEDSSKEAQEKMKYQTIISLYLTVCYHLVKNLVNINARYAMAFHSLERDARLYGIYGSEKDYVEKLKKEQAVLVEKLLSDGPETAGNLHLRSKKWNRLMRVNLENYSAAASQNFRNAVAHLNPIRNADVLIEGIENITSYFDIYHYIVQRSVLNRTNKTPKMKEYEELINKYHTYNKDFVKALCAPFGYNVVRFKALTIYEMFDRNYPEEKRAEEARKSC

SEQ ID NO: 248 - DNA, 36 bp, Artificial Sequence
  DR
taatatgccctatatcaatttataggggttcagaac

SEQ ID NO: 249 - protein, 894 aa, Artificial Sequence
  PIG-028_GL0185479
MSESDKIKIKSKKTRTKRAGLKSSFVSEGKGLMTAFGKGNNAVIEKRISGDLIENVSNKPRFSVEFGNKEYIINDKKLGIVSDDPRESQKPVGEDGIHCKRALEERYFGKTFNDNIHIQLIYSILDLEKILAVHSNNIVYTFDNLRRKETDEYDDFIGYMSTVNSYEEFISPEKLLPGKEQSVYDNINRSQETFLEYRKNPRLGYFGKVFYEKSTDAKDKNKKKMRLISEKEMYYIFALLGGLRQFCTHDKNRARNWLYSLDTMLNDDAKAVLDKYYVSTVSSLNKHFVENSAKKDFSIIFNALNITDIELKKNIAKEYYEFVCRKNFKNIGFSIKKLREYLLEKPEFRNLKDDKYNSVRSKLYRLIDFIIYLNYKDAKFKNDNDEKIERFVSKLRKCPDEASKETVYQTEADIIKKSISGSINSIKRDMMLVKSKYGKLELDTQTVNQLKRAVDDISINTKGDYFTKLMYLISLLIDGKEINDLLTTLIHQFENIASFIDVMKKENIECEFTEKFAFFKNSEIIAHELRTVNSFARMTGFMENDESTKFIMFREAADILGTSYTDDELTDHLNLKKTRLIARSKADMGLRNFIISNVIKSSRFKYLIRYSNPKKVKAIAENKKLVSFVLDKIPDTQIIRYCNTCGFKVGKRQENINTLAEAITYFSFSNFEKVKQSANVENDTPDAIDKAQKQGLISLYLTVLYLFIKNMVYVNSRYVLAFHCLERDSQLLKITSGYNNLSYNNLTNHFIEKEYLNSHARNYLRVNISNSDEWSIVKFRNGVAHLNSVRNIDTSIKGLREFKSYFEIYAYTVQKSIKNYYDAESPVQINPKTIEYMESVDKYGSYTKDFVKALNTPFGYCLARYKNLSIEPLFDRNTVYNKKDVKEEFAVNSK

SEQ ID NO: 250 - DNA, 36 bp, Artificial Sequence
  DR
gaactatagccctccgatttcggagggttctgaaac

SEQ ID NO: 251 - protein, 980 aa, Artificial Sequence
  Ga0224422_10645759
MDKYKLLRNQKFDYVIKLDNIDNIRPILCKEIVNKILKKLKLDFFFSTKEKEIHFTADDIITKKYKKIELVGDDKEVFPIYVRLREVPLKGKAKRLGLKSIFVEDNKLILTTIGKKDDVLIEKEILNNSKNEVISHINPENYAVQEVNYKNISLANDKLKADIDNPSHSKVEETISIKKDYLERKDVIEKKFFNNTFNDNIHIQLAYNIMDINKIFNIYSNEVVFTMENLAHSDDAKDFIGGIDYKKDVIQNAKFNDYFASIFNSLRYFSQAFPNKTFDKIKIDGEKDYNREEIKKNTKIILRILSMFRQFSIHGYTDLFDMEKDPKIRDLLDYFTARYDEVYNNLIRNFIKTSKTNIAIVFEALNLPINDNGLKKEILNDYFDFSITKSYVNMGFNFKRLKEVLISKLGLNVSDSNKQATYNVINYLIYRHLKDNPIVDKYVKCLVASEGDLDKIAIYDAFADEIKLPLKNIITQELVDNQKRNQKYKYFNIDGSWLNTNFNNIDPFCKAIYFLTIFLDTKEINMLVTSIVNKLRNINGLVKVLNNKSDLIYDYRIFDKGNAQKIADQLSVVLSIARMQKNFNKKFKSDNKNSANKPSSDMIYDAYCLFGYKESKETFDEELEADTSKPSKGIAKFQNKITSAIVNSNKFRFIIKYANPRNCYSIMKNTRVVSFVLKEIPQSQIDKYIIKKEKYNSLNYDAKINALAKELADVSIYGMRKAYNIRAKVEANNLELPKLFMTIIYQVIKSLVRINTYYNIAFSCLERDKKLFNVPDDYCDYSDLMLLDAFVYGTNEFEVSKDGKCECITIDVPLNKYERKVDGKIISVQGTKLGSSKYSWLKDDIDVFKEIFYMNNKPTEIESCSVIYRACYRNTIAHLNAISNMTSYLASFVGRNNRMNSYFELYQYIIQMNFINKYKDNYSNEFIDKQSEILKKYKTYSKDLLHILNLPLAYNMARYKNLTIEDIFYDKFINYIKKSE

SEQ ID NO: 252 - DNA, 36 bp, Artificial Sequence
  DR
ggacaataacctgcgaattttggcaggttctatgac

SEQ ID NO: 253 - protein, 996 aa, Artificial Sequence
  ODAI chimera
MLKKCSVCGKKFETNYQGGKPVCRNCRSNKSKPVNPKSSRKPESIDKAIEILTEKLISDCKKNDCASECGKGRRKSKAKAAGLKSALDLGNGQALITSFGKGNEAVPEKRVEGDKIISLREGEAFALAKEPVNHKLVLKSGRIKAEGGPVEFDGPQKNSSMSAVRLDEYNNQIERKFFRGNKVLQDNIRIQIAHNIMDIEKILAVHINNIVYSVNNLFRVQGNEGDDFLGYRGLDKNYSDFCKNKPEDKERFFNFIGKGDGKVTNPRLSYYGAAFAEKVQPTLKYREAEDIYYIICMLGEARQMFAHGNDDRTKTFLYNIVGYRNGTEINSKFTAVLDGIYSKKVEELNGNFIKNSKKDLTILFSAFGCQDEASKKKLIEKYYDFIVKKTNKNMGFSVTKLREKIIEGYRFRGNPVTGTDYDSVRHKLYRTFDFIICSYYDDHAKEKDTLVSSLRASLNDTKKENLYAGEAKTIAESIKDRMDTVCRMYNKGEGIKHITVDRFIAGAGAGKLIDKCSISTECDYFCKFIYLMTLFIDGKEINDLLTTLINKFDNIDSPSVDKAVNNQNRVEFGDKYDMFNKAGEICESLRSINSFARMESPAPAAKRTMFVDAIRMFGFADVSDNDAEKFYKENIEPFIYDRNGDIEDEWKKGKLVHKKDEKKKGVYNFIATNVIESNRFQYLVRYANTEKIAALARNETIVRFVIKKLPAAQIVRYYIACNRIRENINSNVLTSDDMAESLVKLVTGMDFGKIKGVRNDDRSGDKEMKKAIVTLYLTILYHLTKNLVYVNSRYFMAFHCLERDMNLFGEGQKQALRNTGDYPADNADLRRRDIKYCVLTKAHIKQEEVKSRRNDTDSKSQQKAKSRRRRWCLLLKEDIDKLNGCESLRILYRNAVAHLNIPRNAIDYIGGIKKADSYFAIYHYMMQQYLSKKHGLPEGLGCTHGVYCKDLVKALNAPFGYNLPRFKNLSVEALFDMNEEPAPEGKERSKNADGCN

SEQ ID NO: 254 - DNA, 36 bp, Artificial Sequence; identical to SEQ ID NO: 159
  DR

SEQ ID NO: 255 - protein, 6 aa, Artificial Sequence
  HEPN motif
  misc_feature (2)..(5): Xaa can be any naturally occurring amino acid
RXXXXH

SEQ ID NO: 256 - protein, 11 aa, Artificial Sequence
  N-terminal NLS
SPKKKRKVEAS

SEQ ID NO: 257 - DNA, 33 bp, Artificial Sequence
  N-terminal NLS
agccccaagaagaagagaaaggtggaggccagc

SEQ ID NO: 258 - protein, 11 aa, Artificial Sequence
  C-terminal NLS
GPKKKRKVAAA

SEQ ID NO: 259 - DNA, 20 bp, Artificial Sequence
  dCas9 target
uuaucgucuguuuguggaug

SEQ ID NO: 260 - DNA, 33 bp, Artificial Sequence
  C-terminal NLS
ggacctaagaaaaagaggaaggtggcggccgct

SEQ ID NO: 261 - DNA, 271 bp, Artificial Sequence
  Artificial Eubacterium siraeum nCas1 array targeting ccdB
gaacuacacccgugcaaaaaugcaggggucuaaaacuaacggcucucucuuuuauagguguaaaccgaacuacacccgugcaaaaaugcaggggucuaaaaccuuuaucugacagcagacgugcacuggccagaacuacacccgugcaaaaaugcaggggucuaaaaccaucaugcgccagcuuucauccccgauauggaacuacacccgugcaaaaaugcaggggucuaaaacuaauggcguuuuugaugucauuuucgcgguccgcuga

SEQ ID NO: 262 - DNA, 36 bp, Artificial Sequence
  Artificial Eubacterium siraeum nCas1 array targeting ccdB - full 36 nt direct repeat
gaacuacacccgugcaaaaaugcaggggucuaaaac

SEQ ID NO: 263 - DNA, 30 bp, Artificial Sequence
  Artificial Eubacterium siraeum nCas1 array targeting ccdB - spacer 1
uaacggcucucucuuuuauagguguaaacc

SEQ ID NO: 264 - DNA, 30 bp, Artificial Sequence
  Artificial Eubacterium siraeum nCas1 array targeting ccdB - spacer 2
cuuuaucugacagcagacgugcacuggcca

SEQ ID NO: 265 - DNA, 30 bp, Artificial Sequence
  Artificial Eubacterium siraeum nCas1 array targeting ccdB - spacer 3
caucaugcgccagcuuucauccccgauaug

SEQ ID NO: 266 - DNA, 37 bp, Artificial Sequence
  Artificial Eubacterium siraeum nCas1 array targeting ccdB - spacer 4
uaauggcguuuuugaugucauuuucgcgguccgcuga

SEQ ID NO: 267 - DNA, 268 bp, Artificial Sequence
  Artificial uncultured Ruminoccus sp. nCas1 array targeting ccdB
cuacuacacuggugcaaauuugcacuagucuaaaacuaacggcucucucuuuuauagguguaaacccuacuacacuggugcaaauuugcacuagucuaaaaccuuuaucugacagcagacgugcacuggccacuacuacacuggugcaaauuugcacuagucuaaaaccaucaugcgccagcuuucauccccgauaugcuacuacacuggugcaaauuugcacuagucuaaaacuaauggcguuuuugaugucauuuucgcgguccgc

SEQ ID NO: 268 - DNA, 36 bp, Artificial Sequence
  Artificial uncultured Ruminoccus sp. nCas1 array targeting ccdB - full 36 nt direct repeat
cuacuacacuggugcaaauuugcacuagucuaaaac

SEQ ID NO: 269 - DNA, 30 bp, Artificial Sequence; identical to SEQ ID NO: 263
  Artificial uncultured Ruminoccus sp. nCas1 array targeting ccdB - spacer 1

SEQ ID NO: 270 - DNA, 30 bp, Artificial Sequence; identical to SEQ ID NO: 264
  Arificial uncultured Ruminoccus sp. nCas1 array targeting ccdB - spacer 2

SEQ ID NO: 271 - DNA, 30 bp, Artificial Sequence; identical to SEQ ID NO: 265
  Artificial uncultured Ruminoccus sp. nCas1 array targeting ccdB - spacer 3

SEQ ID NO: 272 - DNA, 37 bp, Artificial Sequence; identical to SEQ ID NO: 266
  Artificial uncultured Ruminoccus sp. nCas1 array targeting ccdB - spacer 4

SEQ ID NO: 273 - DNA, 303 bp, Artificial Sequence
  Target RNA (ccdB sequence)
augcaguuuaagguuuacaccuauaaaagagagagccguuaucgucuguuuguggauguacagagugauauuauugacacgcccgggcgacggauggugaucccccuggccagugcacgucugcugucagauaaagucucccgugaacuuuacccgguggugcauaucggggaugaaagcuggcgcaugaugaccaccgauauggccagugugccggucuccguuaucggggaagaaguggcugaucucagccaccgcgaaaaugacaucaaaaacgccauuaaccugauguuuuggggaaua

SEQ ID NO: 274 - DNA, 30 bp, Artificial Sequence
  Target RNA (ccdB sequence) - spacer 1
gguuuacaccuauaaaagagagagccguua

SEQ ID NO: 275 - DNA, 30 bp, Artificial Sequence
  Target RNA (ccdB sequence) - spacer 2
uggccagugcacgucugcugucagauaaag

SEQ ID NO: 276 - DNA, 30 bp, Artificial Sequence
  Target RNA (ccdB sequence) - spacer 3
cauaucggggaugaaagcuggcgcaugaug

SEQ ID NO: 277 - DNA, 30 bp, Artificial Sequence
  Target RNA (ccdB sequence)
accgcgaaaaugacaucaaaaacgccauua

SEQ ID NO: 278 - RNA, 47 nt, Ruminococcus sp.
  misc_feature (30)..(47): n is a, c, g, or u
cacuagugcgaauugcacuagucuaaaacnnnnnnnnnnnnnnnnnn

SEQ ID NO: 279 - protein, 22 aa, Artificial Sequence
  HEPN1 consensus sequence
  misc_feature (5)..(7): Xaa can be any naturally occurring amino acid
  misc_feature (11)..(13): Xaa can be any naturally occurring amino acid
  misc_feature (15)..(22): Xaa can be any naturally occurring amino acid
ILALXXXLRQXXXHXXXXXXXX

SEQ ID NO: 280 - protein, 19 aa, Eubacterium siraeum
VLTLIGKLRHWCVHSEEGR

SEQ ID NO: 281 - protein, 19 aa, Ruminococcus flavefaciens
LTAFAGQLRQWSFHSAGNY

SEQ ID NO: 282 - protein, 19 aa, uncultivated Ruminococcus
MLAIVGQIRQCVFHDKSGA

SEQ ID NO: 283 - protein, 23 aa, Ruminococcus albus
IFALMASLRQSYFHGYVKDTDYQ

SEQ ID NO: 284 - protein, 23 aa, Unknown
  Gut metagenome P1E0
ILSLMSLLRQFCAHDSVRIWGQN

SEQ ID NO: 285 - protein, 22 aa, Anaerobic digester metagenome
IFQILSYVRQSIMHNDIGNKSS

SEQ ID NO: 286 - protein, 23 aa, Ruminococcus flavefaciens
ILALLSGLRHWVVHNNEEEESRI

SEQ ID NO: 287 - protein, 25 aa, Artificial Sequence
  HEPN2 consensus sequence
  misc_feature (1)..(8): Xaa can be any naturally occurring amino acid
  misc_feature (12)..(12): Xaa can be any naturally occurring amino acid
  misc_feature (14)..(14): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(24): Xaa can be any naturally occurring amino acid
XXXXXXXXYRNXVXHKXAXRXXXXY

SEQ ID NO: 288 - protein, 25 aa, Eubacterium siraeum
SERAVVNEFRNTVCHLNAIRNININ

SEQ ID NO: 289 - protein, 25 aa, Ruminococcus flavefaciens
DKYNSITKYRNNVAHLTAVRNCAEF

SEQ ID NO: 290 - protein, 21 aa, uncultivated Ruminococcus
MTRKYRNCIAHLTVVRELKEY

SEQ ID NO: 291 - protein, 25 aa, Ruminococcus albus
CTDGLINTYRNQVDHFAVVRKIGNY

SEQ ID NO: 292 - protein, 25 aa, Unknown
  Gut metagenome P1E0
ISNSLLTAYRNAVDHLNAIPPLGSL

SEQ ID NO: 293 - protein, 26 aa, Anaerobic digester metagenome
LDCEDGFKYYRNQVTHLNAIRVAYKY

SEQ ID NO: 294 - protein, 25 aa, Ruminococcus flavefaciens
IDNKTCTLFRNKAVHLEVARYVHAY

SEQ ID NO: 295 - RNA, 30 nt, Artificial Sequence
  target RNA
uccuacguuuugaucugaaauauucagguc

SEQ ID NO: 296 - RNA, 30 nt, Artificial Sequence
  full length gRNA
aggaugcaaaacuagacuuuauaaguccag

SEQ ID NO: 297 - RNA, 26 nt, Artificial Sequence
  gRNA truncation
ugcaaaacuagacuuuauaaguccag

SEQ ID NO: 298 - RNA, 24 nt, Artificial Sequence
  gRNA truncation
caaaacuagacuuuauaaguccag

SEQ ID NO: 299 - RNA, 22 nt, Artificial Sequence
  gRNA truncation
aaacuagacuuuauaaguccag

SEQ ID NO: 300 - RNA, 21 nt, Artificial Sequence
  gRNA truncation
aacuagacuuuauaaguccag

SEQ ID NO: 301 - RNA, 20 nt, Artificial Sequence
  gRNA truncation
acuagacuuuauaaguccag

SEQ ID NO: 302 - RNA, 19 nt, Artificial Sequence
  gRNA truncation
cuagacuuuauaaguccag

SEQ ID NO: 303 - RNA, 18 nt, Artificial Sequence
  gRNA truncation
uagacuuuauaaguccag

SEQ ID NO: 304 - RNA, 17 nt, Artificial Sequence
  gRNA truncation
agacuuuauaaguccag

SEQ ID NO: 305 - RNA, 16 nt, Artificial Sequence
  gRNA truncation
gacuuuauaaguccag

SEQ ID NO: 306 - RNA, 15 nt, Artificial Sequence
  gRNA truncation
acuuuauaaguccag

SEQ ID NO: 307 - RNA, 14 nt, Artificial Sequence
  gRNA truncation
cuuuauaaguccag

SEQ ID NO: 308 - RNA, 12 nt, Artificial Sequence
  gRNA truncation
uuauaaguccag

SEQ ID NO: 309 - RNA, 10 nt, Artificial Sequence
  gRNA truncation
auaaguccag

SEQ ID NO: 310 - protein, 945 aa, Artificial sequence
  037_-_emb|OIZA01000315.1|
MAKKKRMTAKERKQNHRESLMKKADSNAEKEKAKKPVVENKPDTAISKDNKPKPNKEIKKSKAKLAGVKWIIKANDDVTYISSFGKGNNSVLEKRIIGDVSGDVNKDSHMYVNPKYTKKNYEIKNGFSSGSSLVTYPNKPDKNSGMDALCLKPYFEIDFFGHIFTDNMHIQAIYNIFDIEKILAKHITNIIYTVNSFDRNYNQSGNDTIGFDLNYRVPYLEYGGGKDSNGKPNKISAWKKRENFINFYNEAKPHLGYYENIFYDHGEPISEEKFYNYLNILNFIRNNTFHYKDNDIELYSENYSEEYVFINCLNEFVKNKFKNVNKNFISNEKNNLYIILKAYGEDTENVEVVKKYSKELYKLSVLKTNKNLGVNVKKLRESAIEYGYCPLPYDKEKEVAKLSSVKHKLYKTYDFVITHYLNSNDKLLLEIVETLRLSKNDDEKENVYKKYAEKLFKADDVINPIKAISKLFAEKGNKLFKEKIIIKKEYIEDVSIDKNIYDFTKVIFFMTCFLDGKEINDLLTNIISKLQVIEDHNNVIKFIFHNKDAVYKDYSDKYAIFRNAGKIATELEAIKSIARMENKIENAPKEPLLKDALLALGVSSNDFDEKYEKYFKTDVDADKDHQKVSTFLMNNVINNSRFKYVVKYINPADINGLAKNRYLVKFVLSKIPEEQIDSYYKLFSNEEEPSCEEKIKLLTKKISKLNFQTLFENNKIPNVEKERKKAIITLYFTIVYILVKNLVNINGLYTLALYFVERDGFFYKQICEKKLIETLKKKDKKQLYNDDDYLLLPEIFSGSKYREETKNLKLPKEKDRDIMKKYLPNDKDREEYNKFFKQYRNNIVHLKIIAKLSELTKNIDKDINSYFDIYHYCTQRVMFDYCKKNNNVVLAKMKDLAHIKSDCDEFSSKHTYPYSSAVLRFMNLPFAYNVPRFKNLSYKKFFDKQ

SEQ ID NO: 311 - protein, 924 aa, Artificial sequence
  PIG-022_GL0026351
MAESYKIKSKKTRTKRAGLKSSFVNENKGLMTAFGKGNNAVIEKRISGNLIENVSNKPRFSVEFGNKEYIINDKKLGIVSDDPRESQKPVGEDGIHCKRALEERYFGKTFNDNIHIQLIYSILDLEKILAVHSNNIVYTFDNLRRKETDEYDDFIGYMSTVNSYEEFMNPEKLLPGKDQSVYDNINRSRETFLEYRKNPRLGYFGKVFYEKVTDPKNKSKKKMRLISEKEMYYIFALLGGLRQFCTHDKNRARNWLYSLDTMLNDDAKAVLDKYYVSTVSSLNKHFVDNSAKKDFSIIFNALNITDIELKKNIAKEYYEFVCRKNFKNIGFSIKKLREYLLEKPEFCNLKEDKYNSVRSKLYRLIDFIIYLNYKDAKFENDNDEKIERFVSKLRKCPDEASKETVYQTESDIIKKSIYGSINSIKRGMMSVKSKYGKLELDKQTINQLKRAVDDISINTKGDYFTKLMYLISLLIDGKEINDLLTTLIHQFENIASFIDVMKKENINYEFAEKYKFFNTSKNIACELRTVNSFARMTGFMENDESTKFIMFREAADILGTSYTDDELTDHLNLKKTRLNARSKADTGLRNFIISNVIKSSRFKYLIRYSNPKKVKAIAENKKLVRFVLDKIPDPQIIRYCNTCGFKVGERQENINTLAKAITNFSFSAFEKVKQSANVENDTPDAIDKAQKQGLISLYLTVLYLFIKNMVYVNSRYVLAFHCLERDSQLLKITSGYNNSSYNNLTNYFIDNKYLNPHASRYLKVNISNADEWSIVKFRNGTAHLNSVRNIDTCIEGLKDFKSYFEIYAYTVQKSIKKYFDAEFSEDRNIEDGKISLCNGVYIHERQKNGKPKITVKINPKTIEYMESVDKYGSYTKDFVKALNTPFGYCLARYKNLSIEPLFDRNTVYNKEDVTEEFSVNSKEQ

SEQ ID NO: 312 - protein, 1022 aa, Artificial sequence
  PIG-046_GL0077813
MAKKITAKQRREERERQNKQKWAKKQDDATAVFECEANIKPADSKDEDCANTSIKRKKTQAKAMGLKTVLGFDNKIAIASFTSSKDSKSSHIERITDPNGKTIREDVRMFDSNVDECSINLEKRMTVEERQKDGTIKKDEKDVKSTICNPYSNECGKDYIGIKSVAEELFFGRTFPNDNLRVQIAYNIFDIQKIFGTYINNIIYSFYNLSRDEFQSDNDVIGTLYMLKDFDGQKETDTFRQARALLERTEAYYSYFDNVFKKIDKKKKRNDDYEGKRNEILRYNFNVLRVLSFLRQICAHAKVKVSSDNDREKGGVFVDSLDALFNISSFFDAVAPELNEVINSVYSKGIYDINDNFVKNDKNNFYILSKIYPEVARENLLKEYYYFVVSKEGNNIGISTKKLKEAIIAQDMSYIKSKDYDTYRNKLYTVLCFILVKELNERTTIREQMVADLRANMNGDIGREDIYSKYAKIIYAQVKPRFDGMKNVFEEEAKGVIVPDKEEAVKFSNGALDKSEIERFCITSANTDSVAKIIYFLCKFLDGKEINEFCCAMMNKLDGINDLMETAEQCGAKIEFVDNFNVLSKCGTISGQIRVVKSISKMKKEIDVDNETIFLDAFELLGKRIEKYKKDDSGNVLRNDDGKVLRTKEYNNIRKMLCKKDRRLNFIANSIIKNKWFSYIVRYNQPSECQAIMKNKTLVKFALDELPDLQIQRYFVALYGDEDLPSYGEMRKILLKKLHDFSIRDFDEEIGSLFDEMKRKDKFCESDRKKCLFRLYLTIAYLITKSMVKINTRFSIACATYERDYALLCASNKQERAWSSGATALALTRKFLNQDKLIFEKHYAREGEISKLPKEERKAMRKVNDQLLKQTHFSKHSYCYIVDNVNRLTGGECRTDKRVLPVLNEKNDNAGILSDFRKTIAHLNVVHKMVDYVAEIKGITSYYAFFCYVLQRMPVGNKNEKNALKEKYSETAKSYGTYSKDFMWLINLPFAYNLPRYKNLSNEQLFYDEEERNETEGQIDRL

SEQ ID NO: 313 - protein, 1027 aa, Artificial sequence; identical to SEQ ID NO: 170
  pig_chimera

We claim:

1. A method of targeting one or more target RNA molecules, comprising:
    contacting one or more target RNA molecules with a non-naturally occurring or engineered clustered regularly interspaced short palindromic repeats (CRISPR)-associated (Cas) system comprising:
        at least one Cas13d protein comprising at least 95% sequence identity to SEQ ID NO: 189, or a nucleic acid molecule encoding the at least one Cas13d protein; and
        at least one CRISPR-Cas system guide RNA (gRNA) comprising one or more direct repeat (DR) sequences and one or more spacer sequences, which hybridizes with the one or more target RNA molecules, or at least one nucleic acid molecule encoding the gRNA,
    whereby the Cas13d protein forms a complex with the gRNA, wherein the gRNA directs the complex to the one or more target RNA molecules and targets the one or more target RNA molecules.

2. The method of claim 1, wherein contacting the one or more target RNA molecules with the non-naturally occurring or engineered CRISPR-Cas system comprises introducing into a cell containing the one or more target RNA molecules the non-naturally occurring or engineered CRISPR-Cas system.

3. The method of claim 1, wherein the one or more target RNA molecules are contacted with a complex comprising the at least one Cas13d protein and the at least one CRISPR-Cas system gRNA.

4. The method of claim 1, wherein the least one Cas13d protein:
    further comprises one or more subcellular localization signals, effector domains, purification tags, affinity tags, or combinations thereof.

5. The method of claim 1, wherein
    the one or more DR sequences comprises at least 95% sequence identity to SEQ ID NO: 190.

6. The method of claim 1, wherein targeting one or more target RNA molecules comprises one or more of cutting the one or more target RNA molecules, nicking the one or more target RNA molecules, increasing expression of the one or more target RNA molecules as compared to an amount of target RNA in a corresponding cell or sample not contacted with the at least one Cas13d protein, decreasing expression of the one or more target RNA molecules as compared to an amount of target RNA in a corresponding cell or sample not contacted with the at least one Cas13d protein, visualizing or detecting the one or more target RNA molecules, labeling the one or more target RNA molecules, binding the one or more target RNA molecules, enriching the one or more target RNA molecules, depleting the one or more target RNA molecules, editing the one or more target RNA molecules, trafficking the one or more target RNA molecules, splicing or perturbing the splicing of the one or more target RNA molecules, and masking the one or more target RNA molecules.

7. The method of claim 1, wherein the least one Cas13d protein comprises at least 96% sequence identity to SEQ ID NO: 189.

8. The method of claim 1, wherein the least one Cas13d protein comprises at least 97% sequence identity to SEQ ID NO: 189.

9. The method of claim 1, wherein the least one Cas13d protein comprises at least 98% sequence identity to SEQ ID NO: 189.

10. The method of claim 1, wherein the least one Cas13d protein comprises at least 99% sequence identity to SEQ ID NO: 189.

11. The method of claim 1, wherein the least one Cas13d protein comprises SEQ ID NO: 189.

12. The method of claim 1, wherein the least one Cas13d protein further comprises an effector domain that can cleave RNA, edit a nucleotide, edit a ribonucleotide, methylate RNA, or demethylate RNA.

13. The method of claim 1, wherein the gRNA comprises one or more DR sequences comprising at least 96% sequence identity to SEQ ID NO: 190.

14. The method of claim 1, wherein the gRNA comprises one or more DR sequences comprising at least 97% sequence identity to SEQ ID NO: 190.

15. The method of claim 1, wherein the gRNA comprises one or more DR sequences comprising at least 98% sequence identity to SEQ ID NO: 190.

16. The method of claim 1, wherein the gRNA comprises one or more DR sequences comprising at least 99% sequence identity to SEQ ID NO: 190.

17. The method of claim 1, wherein the gRNA comprises one or more DR sequences comprises SEQ ID NO: 190.

18. The method of claim 1, wherein the gRNA comprises a nucleic acid aptamer.

19. The method of claim 18, wherein the nucleic acid aptamer comprises MS2, PP7, or Qβ.

20. The method of claim 1, wherein the gRNA comprises modified nucleotides.

21. The method of claim 2, wherein the cell is a eukaryotic cell.

22. The method of claim 21, wherein the eukaryotic cell is a mammalian cell.

23. The method of claim 21, wherein the eukaryotic cell is a plant cell.

24. The method of claim 2, wherein the cell is a bacterial cell.

25. The method of claim 1, wherein the at least one Cas13d protein further comprises a nuclear localization signal (NLS).

26. The method of claim 1, wherein the at least one Cas13d protein further comprises a nuclear export signal (NES).

27. The method of claim 26 wherein the NES comprises SEQ ID NO: 287.

28. The method of claim 25 wherein the NLS comprises SEQ ID NO: 256.

29. The method of claim 25 wherein the NLS comprises SEQ ID NO: 258.

* * * * *